(12) United States Patent
Weltzin et al.

(10) Patent No.: US 7,645,456 B2
(45) Date of Patent: *Jan. 12, 2010

(54) VACCINIA VIRUS STRAINS

(75) Inventors: Richard A. Weltzin, Lunenburg, MA (US); Thomas P. Monath, Harvard, MA (US)

(73) Assignee: Sanofi Pasteur Biologics Co., Cambridge, MA (US)

(*) Notice: Subject to any disclaimer, the term of this patent is extended or adjusted under 35 U.S.C. 154(b) by 628 days.

This patent is subject to a terminal disclaimer.

(21) Appl. No.: 10/826,680

(22) Filed: Apr. 16, 2004

(65) Prior Publication Data

US 2009/0169512 A1   Jul. 2, 2009

Related U.S. Application Data

(63) Continuation-in-part of application No. 10/445,671, filed on May 27, 2003, now Pat. No. 7,115,270, which is a continuation of application No. 09/840,751, filed on Apr. 23, 2001, now Pat. No. 6,723,325.

(51) Int. Cl.
*A61K 39/275* (2006.01)
*C12N 1/00* (2006.01)
*A61K 39/285* (2006.01)

(52) U.S. Cl. .................. 424/232.1; 435/235.1

(58) Field of Classification Search .......... None
See application file for complete search history.

(56) References Cited

U.S. PATENT DOCUMENTS 4,315,914 A    2/1982  Arakawa et al.
4,567,147 A    1/1986  Ooi et al.
5,656,465 A    8/1997  Panicali et al.
6,723,325 B1 *  4/2004  Weltzin et al. .......... 424/323.1
7,115,270 B2 * 10/2006  Weltzin et al. .......... 424/232.1

FOREIGN PATENT DOCUMENTS

DE        2 145 477          3/1973
EP        0 157 528          10/1985
WO        WO 02/085411 A1    10/2002

OTHER PUBLICATIONS

Dumbell, K. and M. Richardson, Virological investigations of specimens from buffaloes affected by buffalopox in Maharashtra State, India between 1985 and 1987. Arch Virol (1993) 128:257-267.*

Singh, et al., Comarative sequence analysis of envelope protein genes of Indian buffalopox virus isolates. Arch Virol (2006) 151:1995-2005.*

Tartaglia, et al., Live Vectors as Vaccines: Highly Attenuated Poxvirus Vectors. AIDS Research and Human Retroviruses. 1992; vol. 8, No. 8:1445-7.*

(Continued)

*Primary Examiner*—Bruce R. Campell
*Assistant Examiner*—Stuart W Snyder
(74) *Attorney, Agent, or Firm*—Clark & Elbing LLP (57) ABSTRACT

The invention provides attenuated vaccinia virus vaccines that can be used in methods to prevent or treat small pox in patients, as well as methods of obtaining such vaccines.

2 Claims, 5 Drawing Sheets

OTHER PUBLICATIONS

Kutinova, et al. Search for optimal parent for recombinant vaccinia virus vaccines. Study of three vaccinia virus vaccinal strains and several virus lines derived from them. Vaccine, ,1995; vol. 13. No. 5, pp. 487-493.*

Buller, et al. Deletion of the vaccinia virus growth factor gene reduces virus virulence. Journal of virology (United States) Mar. 1988, 62 (3) p. 866-74.*

Šroller, et al. Effect of 3-b-hydroxysteroid dehydrogenase gene deletion on virulence and immunogenicity of different vaccinia viruses and their recombinants. Arch Virol (1998) 143: 1311-1320.*

Rosengard, et al. Variola virus immune evasion design: expression of a highly efficient inhibitor of human complement. PNAS Jun. 25, 2002 , 99 (13) p. 8808-13.*

Dunlop, et al. Variola virus immune evasion proteins. Microbes and infection / Institut Pasteur ( France ) Sep. 2003, 5 (11) p. 1049-56.*

Kim, et al. Evidence that vaccinia virulence factor ER binds to Z-DNA in vivo: Implications for development of a therapy for poxvirus infection. PNAS. 2004, V 101, N6 ( FEB 10 ), p. 1514-1518.*

Abrahams, et al. The vaccinia virus N1L ORF may encode a multifunctional protein possibly targeting different kinases, one of which influences ATP levels in vivo. Annals of the New York Academy of Sciences (United States) Nov. 2005, 1056 p. 87-99.*

Cooray, et al. Functional and structural studies of the vaccinia virus virulence factor N1 reveal a Bcl-2-like anti-apoptotic protein. Journal of general virology (England) Jun. 2007, 88 (Pt 6) p. 1656-66.*

Osborne, et al. Genomic differences of vaccinia virus clones from Dryvax smallpox vaccine: The Dryvax-like ACAM2000 and the mouse neurovirulent Clone-3. Vaccine. 2007.*

Dumbell, K. and M. Richardson, Virological investigations of specimens from buffaloes affected by buffalopox in Maharashtra State, India between 1985 and 1987. Arch Virol (1993) 128:257-267.*

Singh, et al., Comarative sequence analysis of envelope protein genes of Indian buffalopox virus isolates. Arch Virol (2006) 151:1995-2005.*

Halstead et al., "Selection of Attenuated Dengue 4 Viruses by Serial Passage in Primary Kidney Cells," Am. J. Trop. Med. Hyg. 33(4):666-671, 1984.

Henderson et al., "Consensus Statement: Smallpox as a Biological Weapon. Medical and Public Health Management," JAMA 281:2127-2137, 1999.

Jennings et al., "Virus Vaccines," In: Virus Culture, a Practical Approach, ed. A.J. Cann, Oxford University Press, New York 149-182, 1999.

Kutinova et al., "Search for Optimal Parent for Recombinant Vaccinia Virus Vaccines. Study of Three Vaccinia Virus Vaccinal Strains and Several Virus lines Derived from them," Vaccine 13:487-493, 1995.

Kutinova et al., "Influence of the Parental Virus Strain on the Virulence and Immunogenicity of Recombinant Vaccinia Viruses Expressing HBV preS2-S Protein or VZV Glycoprotein I," Vaccine 14:1045-1052, 1996.

Lee et al., "Molecular Attention of Vaccinia Virus: Mutant Generation and Animal Characterization," Journal of Virology 66:2617-2630, 1992.

LeDuc et al., "Current Status of Smallpox Vaccine," Emerging Infectious Diseases 5:593, 1999.

Liprandi, "Isolation of Plaque Variants Differing in Virulence from the 17D Strain of Yellow Fever Virus," J. gen. Virol 56:363-370, 1981.

Marchevsky et al., "Phenotypic Analysis of Yellow Fever Virus Derived from Complementary DNA," The American Society of Viral Medicine and Hygiene 5200:75-80, 1995.

Weltzin et al., "Clonal Vaccinia Virus Grown in Cell Culture as a New Smallpox Vaccine," Nature Medicine 9:1125-1130, 2003.

Weltzin et al., U.S. Appl. No. 10/445,671, filed May 27, 2003.

Goebel et al., "The Complete DNA Sequence of Vaccinia Virus," Virology 179:247-266, 1990.

Plotke et al., "Comparative Results of Smallpox Revaccination Using Regular and Dry Smallpox Vaccine (DryVax)," Illinois Medical Journal 125:140-141, 1964.

International Preliminary Report on Patentability from International Application No. PCT/US2005/012947.

* cited by examiner

Experiment 2

VACCINIA VIRUS STRAINS

CROSS REFERENCE TO RELATED APPLICATIONS

This application is a continuation-in-part of, and claims priority from, U.S. Ser. No. 10/445,671, filed May 27, 2003 now U.S. Pat. No. 7,115,270, which is a continuation of U.S. Ser. No. 09/840,751, filed Apr. 23, 2001 now U.S. Pat. No. 6,723,325. Each of the prior applications is incorporated herein by reference.

This invention was made with Government support under Grant No. 1N01AI000071-001 awarded by National Institute of Allergy and Infectious Diseases. The Government has certain rights in this invention.

BACKGROUND OF THE INVENTION

This invention relates to vaccinia virus strains, compositions including the strains, and methods employing the strains.

Variola virus, the causative agent of smallpox, is a member of the Orthopoxvirus genus, which also includes monkeypox, cowpox, and vaccinia viruses. The disease caused by variola major strains is characterized by a low infectious dose (10-100 virions), a long incubation period (averaging 12 days), fever, constitutional symptoms, rash progressing to a pustular stage, death in up to 30% of those affected, and scarring in survivors. The disease is spread person-to-person via the respiratory route by contact (droplets) and, possibly, by aerosol.

Smallpox was one of the most important causes of morbidity and mortality worldwide throughout the first half of the $20^{th}$ century. However, in part because of the lack of an animal reservoir for the virus, the systematic use of a vaccine (live, attenuated vaccinia virus) was highly effective in fighting this disease. Indeed, between 1967-1977, a global program of smallpox eradication resulted in the elimination of the natural disease (Fenner et al., WHO, Geneva, p. 1460, 1988). Because of the absence of smallpox and the risk of vaccine-associated adverse events, routine vaccination of children, hospital personnel, and military personnel was ceased, leaving only persons working with vaccinia and related viruses in the laboratory being immunized. Thus, a substantial portion of the world's population has no immunity to smallpox. The remaining population has little residual immunity, as vaccine immunity lasts only 5 years after primary vaccination and less than 20 years after revaccination. The eradication of smallpox and the cessation of vaccination have, thus, created vulnerability in the population to covert attack or biowarfare employing variola virus. Should such an event occur, epidemic spread would be unchecked by an immune barrier in the population (Anon. (Editorial), Lancet 353:1539, 1999; Henderson, Science 283:1279-1282, 1999; Henderson et al., J.A.M.A. 281:2127-2137, 1999).

Because of the uncertainties surrounding the smallpox eradication, vaccine was stockpiled for emergency use. In the United States, for example, 155,000 vaccine vials (nominally 15.5 million doses) produced by Wyeth Laboratories were originally stockpiled under the control of the Centers for Disease Control and Prevention (CDC), Atlanta, Ga. At a meeting of the National Vaccines Advisory Committee in January 1999, the CDC reported on the status of the national smallpox vaccine repository. At that time, of the 15.5 million doses held by Wyeth, 3.4 million doses had failed quality control testing and 10.3 million were beyond the expiration date specified by the last control test for extended dating, leaving 1.7 million doses that met release specifications (LeDuc, Presentation to the National Vaccines Advisory Committee, Washington D.C., Jan. 11-12, 1999). In addition to the limited supply, the vaccine is packaged in 100 dose vials, which restricts distribution and increases the likelihood of wastage during an emergency.

In addition to the U.S. stockpile, there is a supply of vaccine (Lister, Elstree strain) stored at the National Institute of Public Health, Bilthoven, Netherlands, and certain other countries have supplies of smallpox vaccine, which at the time of eradication may have included up to 300 million doses. However, similar problems of stability in storage have reduced this supply to less than 50 million doses (Henderson, Science 283:1279-1282, 1999).

SUMMARY OF THE INVENTION

The invention provides stable strains of vaccinia virus that are isolated from cultured cells in which Dryvax® has been propagated, and which have characteristics that make them suitable for use as human vaccines against smallpox. The invention also provides methods of generating these strains and methods of using them to prevent and treat smallpox infection and disease.

Accordingly, in a first aspect, the invention provides a clonal strain of attenuated vaccinia virus that is isolated from cultured cells in which Dryvax®, ACAM1000, ACAM2000, or a variant thereof (see below) has been cultured and, when administered to a human in an amount effective to induce a protective or therapeutic immune response against variola virus in the human, is acceptably attenuated in the human.

The clonal strains can have, for example, substantially the same virulence and/or immunogenicity as Dryvax®. Preferably, the vaccinia virus is produced in substantially the same or greater amounts as Dryvax® when inoculated into cell cultures, and/or has substantially the same digestion pattern as Dryvax® when digested with a restriction endonuclease.

The clonal strain can also have, for example, substantially the same virulence and/or immunogenicity as vaccinia virus strain ACAM1000 or ACAM2000 (deposited as ATCC Deposit No. PTA-3321 on Apr. 19, 2001; see clone 2, below) when tested in appropriate animal models or in humans. The vaccinia virus also be produced in substantially the same or greater amounts as vaccinia virus strain ACAM1000 or ACAM2000 when inoculated into cell cultures, and/or has substantially the same digestion pattern as vaccinia virus strain ACAM1000 or ACAM2000 when digested with a restriction endonuclease. ACAM1000 and ACAM2000 have been found to have the same sequences, but have been given different designations to reflect the cell cultures in which they are typically propagated (ACAM1000-MRC5 cells; ACAM2000-Vero cells).

In a second aspect, the invention provides a pharmaceutical composition including a clonal strain of vaccinia virus, as described above and elsewhere herein, and a pharmaceutically acceptable carrier or diluent.

In a third aspect, the invention provides a method of preventing or treating variola virus infection in a patient by administering such a pharmaceutical composition to the patient. The pharmaceutical composition can be administered to the patient by, for example, scarification, in an amount ranging from, for example, $1 \times 10^4$ to $1 \times 10^6$ plaque-forming units.

In a fourth aspect, the invention provides a method of obtaining a clonal strain of attenuated vaccinia virus for use as a vaccine. This method involves (i) propagating Dryvax® or another vaccinia strain as described herein (e.g., ACAM1000 or ACAM2000) in a cell culture system, and (ii) isolating from the cell culture system a clonal strain of vaccinia virus that has substantially the same virulence, immunogenicity, growth characteristics in culture, or restriction endonuclease digestion pattern as Dryvax®, vaccinia virus strain ACAM1000, or vaccinia virus strain ACAM2000. The virulence of the vaccinia virus can be tested in this method by, for example, a rabbit skin test or a suckling mouse neurovirulence test. Growth characteristics in culture can be determined using, e.g., human diploid (MRC-5) cells or Vero cells. Preferably, the vaccinia virus identified using this method, when administered to a human in an amount effective to induce a protective or therapeutic immune response against variola virus in the human, is acceptably avirulent in the human.

In a fifth aspect, the invention includes clonal strains of attenutated vaccinia virus that have nucleotide sequences that are substantially identical to the sequence of SEQ ID NO: 1 or SEQ ID NO:2. The nucleotide sequence can be, e.g., at least 70%, 80%, 90%, 95%, or 98% identical to the sequence of SEQ ID NO: 1 or SEQ ID NO:2 (also see below).

In a sixth aspect, the invention includes clonal strains of attenutated vaccinia viruses that have nucleotide sequences that hybridize to the sequence of SEQ ID NO: 1 or SEQ ID NO:2, a fragment of SEQ ID NO: 1 or SEQ ID NO:2, or the complement of SEQ ID NO: 1 or SEQ ID NO:2, under highly stringent conditions. The fragment can include, for example, a coding sequence selected from the group consisting of SEQ ID NOs:3-471 (odd numbers), or the complement thereof.

In a seventh aspect, the invention provides clonal strains of attenuated vaccinia virus that have nucleotide sequences that encode a polypeptide selected from the group consisting of SEQ ID NOs:4-472 (even numbers).

Further, in an eighth aspect, the invention provides clonal strains of attenuated vaccinia viruses that include one or up to 235 polypeptides having amino acid sequences that are substantially identical to those encoded by the sequences of SEQ ID NOs: 1 or 2, or the complements thereof. For example, the clonal strains can include 235 polypeptides having amino acid sequences that are substantially identical to those encoded by the sequences of SEQ ID NOs: 1 or 2, or the complements thereof.

A polynucleotide of the invention hybridizes, preferably under stringent conditions, to a polynucleotide having a sequence as shown in the sequence listing (SEQ ID NOs: 1 or 2, odd numbers of SEQ ID NOs:3-471, or the complements thereof). Hybridization procedures are described, e.g., by Ausubel et al. (Current Protocols in Molecular Biology, John Wiley & Sons, New York, N.Y., 1998), Silhavy et al. (Experiments with Gene Fusions, Cold Spring Harbor Laboratory Press, Cold Spring Harbor, N.Y., 1984), and Davis et al. (A Manual for Genetic Engineering: Advanced Bacterial Genetics, Cold Spring Harbor Laboratory Press, Cold Spring Harbor, N.Y., 1980).

Important parameters that can be considered for optimizing hybridization conditions are reflected in the following formula, which facilitates calculation of the melting temperature (Tm), which is the temperature above which two complementary DNA strands separate from one another (Casey et al., Nucl. Acid Res. 4:1539, 1977): Tm=81.5+0.5×(% G+C)+1.6 log (positive ion concentration)−0.6×(% formamide). Under appropriate stringency conditions, hybridization temperature (Th) is approximately 20 to 40° C., 20 to 25° C., or, preferably, 30 to 40° C. below the calculated Tm. Those skilled in the art will understand that optimal temperature and salt conditions can be readily determined empirically in preliminary experiments using conventional procedures. For example, stringent conditions can be achieved, both for pre-hybridizing and hybridizing incubations, (i) within 4-16 hours at 42° C., in 6×SSC containing 50% formamide or (ii) within 4-16 hours at 65° C. in an aqueous 6×SSC solution (1 M NaCl, 0.1 M sodium citrate (pH 7.0)). For polynucleotides containing 30 to 600 nucleotides, the above formula is used and then is corrected by subtracting (600/polynucleotide size in base pairs). Stringent conditions are defined by a Th that is 5 to 10° C. below Tm.

In another example, high stringency conditions can be defined as conditions that allow hybridization comparable with the hybridization that occurs using a DNA probe of at least 100, e.g., 200, 350, or 500, nucleotides in length, in a buffer containing 0.5 M NaHPO$_4$, pH 7.2, 7% SDS, 1 mM EDTA, and 1% BSA (fraction V), at a temperature of 65° C., or a buffer containing 48% formamide, 4.8×SSC, 0.2 M Tris-Cl, pH 7.6, 1×Denhardt's solution, 10% dextran sulfate, and 0.1% SDS, at a temperature of 42° C. Additional information concerning high stringency conditions can be found, for example, in Ausubel et al. (supra).

By "polypeptide" or "protein" is meant any chain of amino acids, regardless of length or post-translational modification (e.g., glycosylation or phosphorylation). Both terms are used interchangeably in the present application.

By "homologous amino acid sequence" is meant an amino acid sequence that differs from an amino acid sequence shown in the sequence listing (even numbers, SEQ ID NOs: 4-472) or sequence appendices, or an amino acid sequence encoded by a nucleotide sequence shown in the sequence listing (odd numbers, SEQ ID NOs:3-471) or sequence appendices, by one or more (e.g., 1-200, 5-150, 10-100, 25-75, or 50-60) non-conservative amino acid substitutions, deletions, or additions. Such a sequence can be, for example, at least 75%, 80%, 90%, 95%, 97%, 98%, or 99% identical to an amino acid sequence shown in the sequence listing (even numbers, SEQ ID NOs:4-472) or sequence appendices. The invention includes clonal strains of attenuated vaccinia viruses that include one or up to 235 proteins having amino acid sequences that are homologous with the amino acid sequences of the sequence listing or sequence appendices.

Homologous amino acid sequences include sequences that are identical or substantially identical to an amino acid sequence as shown in the sequence listing (even numbers, SEQ ID NOs:4-472) or sequence appendices. By "amino acid sequence that is substantially identical" is meant, for example, a sequence that is at least 80%, 90%, 95%, 97%, or 99% identical to an amino acid sequence of reference and that differs from the sequence of reference, if at all, by a majority of conservative amino acid substitutions.

Conservative amino acid substitutions typically include substitutions among amino acids of the same class. These classes include, for example, amino acids having uncharged polar side chains, such as asparagine, glutamine, serine, threonine, and tyrosine; amino acids having basic side chains, such as lysine, arginine, and histidine; amino acids having acidic side chains, such as aspartic acid and glutamic acid; and amino acids having nonpolar side chains, such as glycine, alanine, valine, leucine, isoleucine, proline, phenylalanine, methionine, tryptophan, and cysteine.

Homology can be measured using sequence analysis software (e.g., Sequence Analysis Software Package of the Genetics Computer Group, University of Wisconsin Biotechnology Center, 1710 University Avenue, Madison, Wis. 53705). Similar amino acid sequences are aligned to obtain the maximum degree of homology (i.e., identity). To this end, it may be necessary to artificially introduce gaps into the sequence. Once the optimal alignment has been set up, the degree of homology (i.e., identity) is established by recording all of the positions in which the amino acids of both sequences are identical, relative to the total number of positions.

Homologous polynucleotide sequences are defined in a similar way. For example, a homologous sequence can be one that is at least 55%, 60%, 75%, 85%, 90%, 95%, 97%, 98%, or 99% identical to a sequences of any of the nucleotide sequences set forth in the sequence listing (SEQ ID NOs: 1 and 2; odd numbers of SEQ ID NOs:3-471) or sequence appendices (also see below).

The invention provides several advantages. For example, previously, smallpox vaccine was produced by inoculation of vaccinia virus into the skin of calves, followed by scraping of the skin of the calves to harvest live virus. The crude virus preparation obtained underwent minimal purification before use in vaccinating human recipients, leaving open the possibility of pathogen contamination. The vaccines of the present invention are produced in a cell culture system that is acceptable by modem standards for vaccine manufacture and is highly purified, thus eliminating this problem. An additional advantage of using cloned viruses, such as those of the present invention, is that the characteristics of such viruses are unlikely to change during propagation and vaccine manufacturing, as compared to mixed populations of viruses. Indeed, we have shown that a virus according to the invention maintains its phenotype under repeated passage and expansion in cell culture, is free from contaminants, and is capable of being produced in cell culture in amounts suitable for large-scale vaccine manufacture.

Other features and advantages of the invention will be apparent from the following detailed description, the drawings, and the claims.

DETAILED DESCRIPTION

The invention provides clonal strains of attenuated vaccinia viruses that can be used in vaccination methods against smallpox (i.e., variola virus). As is described further below, the attenuated vaccinia strains of the invention can be obtained by isolating vaccinia clones from cell cultures in which Dryvax®, ACAM1000, or ACAM2000 has been propagated. The invention also provides methods of using vaccines that include these vaccinia viruses in the prevention or treatment of smallpox, as well as methods of obtaining such clonal strains of vaccinia viruses.

The vaccines of the invention are derived from, and have similar characteristics to, Dryvax® (New York City Board of Health strain, Wyeth Laboratories), which is currently licensed by the U.S. Food and Drug Administration (FDA) and consists of a mixed population of vaccinia viruses generated in calf skin. The vaccines must have acceptably attenuated virulence for humans who are vaccinated with them. An acceptable level of attenuation can be, for example, a level that is similar to (e.g., does not differ in a statistically significant manner from) that observed with Dryvax®, and can be determined using any of the in vitro or in vivo tests described below. A property of vaccinia virus is its neurotropism, or ability to replicate in cells of the central nervous system, causing inflammation (i.e., encephalitis). Preferably, the vaccines of the invention are not more neurotropic than Dryvax® and do not cause postvaccinal encephalitis in treated patients.

The vaccines and methods of the present invention are described further below.

Indications for Use

The principal indication for use of the vaccines of the invention is in the prevention of smallpox in populations exposed or potentially exposed to smallpox after an act of bioterrorism or biowarfare. Efficacy of the vaccines of the invention advantageously is high (>95%), and the vaccines protect against both person-person spread of the virus and primary exposure to high-dose aerosol exposure to biological weapons. Given this principal indication, the vaccines of the invention can be used, for example, to create a new national stockpile of smallpox (vaccinia) vaccine, and manufacture can be continued annually to maintain a continuous stock of in-date vaccine for an extended period of time.

The vaccines are not necessarily intended for routine use, except in laboratory workers who are exposed to vaccinia, cowpox, monkey pox, variola, or other members of the Orthopoxvirus genus. Otherwise, the vaccines are to be released under emergency conditions, as determined by the national security and public health authorities. Under the circumstances of such an emergency, the risks of adverse events associated with vaccinia would be outweighed by the potential benefits of protecting individuals against smallpox and society against spread of the disease. It is recognized that emergency use of the vaccines may be difficult to control, that infants, who are at higher risk of postvaccinal encephalitis, will receive the vaccines, and that precautions and contraindications for use in persons with underlying conditions (e.g., history of eczema, pregnancy, and immunosuppression) may be ignored. For these reasons, it is important that the cell culture-derived vaccines of the invention are not more virulent than the currently licensed product.

Depending upon events that cannot be accurately predicted, there may be a decision to undertake pre-exposure prophylaxis of certain groups, including military personnel, civilian medical personnel, and so-called 'first responders.' The inherent safety profile of the vaccines in these groups, while of great importance, is enhanced by deliberate application of the product and avoidance of use in individuals with risk factors for adverse events. Under these circumstances, the principal risks are autoinoculation, ocular vaccinia, and accidental infection, all of which are self-limited adverse events. There is a small risk of accidental infection of others with underlying risk factors.

Of course, should circumstances in the country or world change such that routine vaccination of additional members of the population (e.g., children), or even the entire population, is thought to be desirable, the vaccines of the present invention can be used for these purposes as well.

Modes and Amounts of Administration

The vaccines of the invention are prepared by propagation of a desired strain of vaccinia virus (e.g., strain ACAM1000, ACAM2000, or a variant thereof; ATCC Deposit No. PTA-3321; see below) in a cell culture system, and purification of the cultured strain from the system using standard methods. For example, the strain can be cultured in diploid human lung fibroblast cells, such as MRC-5 cells, primary chick embryo fibroblast cells, Vero cells, or any other appropriate cell type, as can be determined by those of skill in this art. The culture can take place using any appropriate system such as, for example, the Nunc Cell Factory®.

Purified virus can be lyophilized for later use or can be immediately prepared in a pharmaceutical solution. Numerous pharmaceutically acceptable solutions for use in vaccine preparation are well known in the art and can readily be adapted for use in the present invention by those of skill in this art. (See, e.g., Remington's Pharmaceutical Sciences (18$^{th}$ edition), ed. A. Gennaro, 1990, Mack Publishing Co., Easton, Pa.) However, the viruses can simply be diluted in a physiologically acceptable solution, such as sterile saline or sterile buffered saline, with or without an adjuvant or carrier. Optionally, the pharmaceutical solution can contain a component that provides viscosity (e.g., glycerol) and/or a component that has bactericidal properties (e.g., phenol). The vaccines can be stored at a concentration of $10^7$-$10^9$ plaque-forming units (PFU)/ml, for example, $10^8$ PFU/ml.

The vaccines of the invention can be administered to patients by, for example, scarification, using standard methods. For example, a bifurcated needle can be used in such an approach. Alternatively, the vaccine can be administered using any other standard route that is found to be acceptable by those of skill in this art. For example, the vaccine can be administered by subcutaneous or intradermal injection, or by another parenteral route, such as by intramuscular injection. The amount of vaccine administered to an average-sized adult can be, for example, $1 \times 10^4$ to $1 \times 10^6$ plaque-forming units. As a specific example, $2.5 \times 10^5$ plaque-forming units can be used.

Preferably, vaccination is carried out before any exposure to variola, but vaccination can also be carried out with patients who have been exposed to variola, preferably within a few days of the exposure. Vaccination can be carried out only once in a person's lifetime or can be repeated after a period of time, such as several years (e.g., 5-10 years), as determined to be appropriate by those of skill in this art.

Identification of Vaccine Candidates

The invention also includes methods of identifying vaccinia vaccine candidates. These candidates can be identified by isolating clonal strains from cell cultures inoculated with Dryvax®, and characterizing these clones using any of the in vitro or in vivo methods described below. For example, a candidate vaccine strain can be compared with Dryvax® for plaque size, yield in cell culture (using, e.g., MRC-5 or Vero cells), rabbit cutaneous virulence, suckling mouse neurovirulence, monkey neurovirulence, or protection in a mouse challenge model. Preferred candidates are those with virulence that is similar to or less than that of Dryvax®, which induce protective immunity that is similar to or greater than that of Dryvax®, and also have growth characteristics that are similar to or greater than those of Dryvax®. Candidates that are variants of ACAM1000 or ACAM2000 can also be tested.

Prior to the present invention, isolation of a clonal strain that has satisfactory characteristics of a vaccine candidate was unpredictable, because the long history of passage of vaccinia has resulted in the generation of multiple subpopulations of variants (i.e., a genetic swarm), with potentially different biological properties. It was also uncertain whether a single variant, isolated by plaque purification (i.e., biological cloning) would have the same phenotypic characteristics as the sum of the multiple variants in the original mixed virus population. In fact, prior to the present invention, it would have been surprising if this were the case. Based on the present invention, it is now known for the first time that clonal isolates of Dryvax® can be effective.

Development and preclinical characterization of vaccines of the invention is described further, as follows.

Development and Preclinical Characterization of Vaccinia Vaccines

As is discussed above, Dryvax® is the vaccinia vaccine that is currently licensed by the FDA, was derived from the New York City Board of Health (NYCBH) strain, and was produced up to 1982 by Wyeth-Lederle by the bovine calf lymph method (also see ATCC Deposit No. VR-325). Dryvax® consists of a live, attenuated vaccinia virus and does not exist as a cell culture product. We adapted the smallpox vaccine strain of vaccinia virus for propagation under controlled conditions in laboratory-grown cultures of human lung fibroblast cells so that modern techniques could be used for vaccine production. To develop a cell culture vaccine, we had to separate Dryvax® from potential adventitious viral contaminants by passage at terminal dilution, and we did this with and without cloning, as is discussed further below. From the mixture of variants (the genetic swarm) in Dryvax®, we selected candidate vaccines that have similar biological characteristics in animals and genomic similarity to the licensed vaccine, providing a high degree of certainty that they are as effective clinically as the original calf lymph product.

In one strategy used for adaptation, the vaccinia virus was cloned to isolate the virus from possible contaminating microorganisms derived from calf skin. Through use of this strategy, six clones were isolated. The cloned viruses exhibited a variety of characteristics with greater or lesser virulence when compared to Dryvax®. Surprisingly, given the expected mixture of variants in Dryvax®, three clones were found to be similar to Dryvax® in virulence tests in animals and differed primarily in growth rate in cell culture. Any of these strains, as well as others with similar characteristics, can be used in smallpox vaccination methods, according to the invention.

In another strategy, the virus was not cloned, with the expectation that virus derived by this method would be more likely to behave like the strain from which it was derived. Surprisingly, we found, however, that the strain produced without cloning, while behaving similarly to Dryvax® in in vitro tests, did not have the characteristics of the vaccine strain, but in fact was more virulent when tested in laboratory animals. Thus, we focused our development efforts on cloned viruses with characteristics similar to those of the Dryvax® vaccine strain. The details of our characterization are as follows.

Dryvax® was inoculated into cultures of MRC-5 cells and six clones of vaccinia virus were obtained by plaque-purification. Each clone was recloned twice to ensure clonality and freedom from contaminants. Dryvax® was also inoculated into MRC-5 cell cultures at a multiplicity of infection (MOI) of 0.001 PFU per cell to derive an uncloned (polyclonal) virus preparation. This virus was subsequently passed in MRC-5 cells twice more at low MOI. All six clones and the polyclonal preparation were tested in an extensive series of comparative analyses along side Dryvax® for in vitro and in vivo characteristics. In particular, each clone and the polyclonal preparation were analyzed for plaque morphology, yield in MRC-5 cells, restriction endonuclease mapping patterns, the formation of cutaneous pocks in rabbits, and mouse neurovirulence. A subset of clones was further tested for induction of protective immunity in mice. The objective was to select a vaccine strain from the Dryvax® pool with biological similarity to Dryvax®. Table 1 summarizes the results of these studies.

TABLE 1

Characterization of 7 vaccinia virus candidates

Results (relative to Dryvax ® for qualitative assays)

| Test | Dryvax ® | Clone 1 | Clone 2 | Clone 3 | Clone 4 | Clone 5 | Clone 6 | Poly |
|---|---|---|---|---|---|---|---|---|
| Plaque size (mean, mm) | 0.42 | 0.43 | 0.49 | 0.36 | 0.65 | 0.25 | 0.27 | 0.46 |
| Yield in MRC-5[†] | 4.0 | 13.5 | 7.0 | 10.6 | 15.6 | 4.7 | 1.5 | 7.0 |
| RE analysis | | Same | Same | Same | Same | Same | Same | Same |
| Rabbit skin test | | High | Same | High | Same | High | Same | High |
| Suckling mouse neurovirulence | | High | Same | High | Same | High | Same | High |
| Immunogenicity in mice | | Not tested | Same | Same | Same | Not tested | Not tested | Not tested |

[†]pfu/ml × $10^6$

From these studies, clones 2 and 4 were identified as having characteristics which show that these clones are suitable for use as a new smallpox vaccine. Clone 6 also has suitable characteristics, but does not grow as well as clones 2 and 4 in culture.

Suckling Mouse Neurovirulence

Adult mice were determined to be insusceptible to intracranial (IC) inoculation of unmodified Dryvax®. A test in suckling mice was therefore developed. Suckling mice (3-4 days old) were injected with tenfold dilutions of virus and survival time was determined. Three experiments were conducted, with Dryvax® tested in each as a standard. We observed that suckling mice inoculated IC with Dryvax® uniformly developed fatal encephalitis with an $LD_{50}$ of ~1.0 $log_{10}$ PFU and a mean time to death of seven days. This test was thus determined to be useful for comparing neurovirulence of vaccine candidates with parental Dryvax®. The results of these experiments are summarized in Table 2, and the number of mice surviving and the average survival times found in this analysis are shown in FIGS. 1A-1D.

TABLE 2

Neurovirulence for suckling mice, vaccinia vaccine candidates

| | | Parameter | | | |
|---|---|---|---|---|---|
| Experiment | Virus | $LD_{50}$[1] | $LD_{90}$[1] | AST[2] | (SD) |
| 1 | Dryvax ® | 1.68 | 3.03 | 7.78 | (4.19) |
| | Polyclonal | <1.3 | 1.94 | 6.09 | (1.14) |
| | Clone 1 | <2.3 | <2.3 | 4.20 | (1.03) |
| 2 | Dryvax ® | 1.3 | 2.1 | 6.67 | (0.71) |
| | Clone 2 | 1.55 | 2.25 | 6.80 | (2.74) |
| | Clone 3 | <1.3 | <1.3 | 5.00 | (1.16) |
| | Clone 4 | 2.59 | 3.16 | 6.11 | (1.36) |
| 3 | Dryvax ® | 2.4 | 4.15 | 8.64 | (3.42) |
| | Clone 5 | <1.3 | <1.3 | 4.08 | (1.08) |
| | Clone 6 | 1.57 | 2.47 | 7.73 | (4.63) |

[1]50% intracerebral lethal dose per 0.02 mL inoculum on day 10 after infection
[1]90% intracerebral lethal dose per 0.02 mL inoculum on day 10 after infection
[2]Average survival time, days (standard deviation) at ~10-100 $LD_{50}$ Additional tests can be used to test the virulence of vaccine candidates. For example, we developed a rabbit cutaneous virulence test. This test was successfully developed using intradermal inoculation of unpassaged Dryvax®, which produced dose-related pock lesions characterized by erythema, induration, and in some cases a central lesion. As another example, a monkey neurovirulence test can be used. In this test, a cloned Dryvax®-derived candidate is tested against Dryvax® by IC inoculation of graded virus doses.

We also developed a mouse challenge model for protection tests. In this model, the WR strain of vaccinia was used to challenge 6-8 week-old mice by the intranasal (IN) route. The $LD_{50}$ is ~4.5 $log_{10}$ PFU and the mean time to death is 6-7 days after challenge. The test is sufficiently robust to use in pre-clinical protection studies with the new vaccine candidate. Similar models using other Orthopoxviruses, such as cowpox virus, can also be used.

The ability of Dryvax® and clones 2 and 4 to induce protective immunity against vaccinia WR challenge in mice was tested. Clone 3 was also tested to determine whether a clone with greater virulence also induces a greater immune response. Four-week-old mice were immunized with graded doses of each virus strain. The virus was inoculated into the skin by scarification with a bifurcated needle, which is the method used to inoculate Dryvax® in humans. Three weeks after immunization, the mice were challenged with 6.5 $log_{10}$ PFU (100 $LD_{50}$) of vaccinia WR by the IN route. Survival rate over 14 days after challenge was determined. Dose-responsive protection was seen with all virus strains, and all clones protected mice at least as well as Dryvax®. There were no differences in the protective activity among the clones. The average survival times at different immunizing doses are summarized in Table 3 and the 50% protective doses ($PD_{50}$) are shown in Table 4.

TABLE 3

Survival time of immunized mice following challenge with 100 $LD_{50}$ of vaccinia WR.

| Immun. dose | Average survival time (days) | | | |
|---|---|---|---|---|
| (log10 pfu/ml) | Dryvax | Clone 3 | Clone 2 | Clone 4 |
| 8 | 14.0 | NT | 14.0 | NT |
| 7 | 14.0 | 14.0 | 14.0 | 14.0 |
| 6 | 12.0 | 14.0 | 12.4 | 12.4 |
| 5 | 7.6 | 8.8 | 7.2 | 7.0 |
| 4 | 5.2 | 5.2 | 7.8 | 5.4 |
| 3 | 5.6 | 5.4 | 5.4 | 4.8 |
| 2 | 5.2 | 5.8 | 5.2 | NT |

TABLE 4

50% protective doses of Dryvax ® and vaccine candidates.
PD50 (log10 pfu)

| Dryvax | Clone 3 | Clone 2 | Clone 4 |
| --- | --- | --- | --- |
| 5.5 | 5.2 | 5.4 | 5.5 |

Restriction Endonuclease Analysis

Figure 1A:
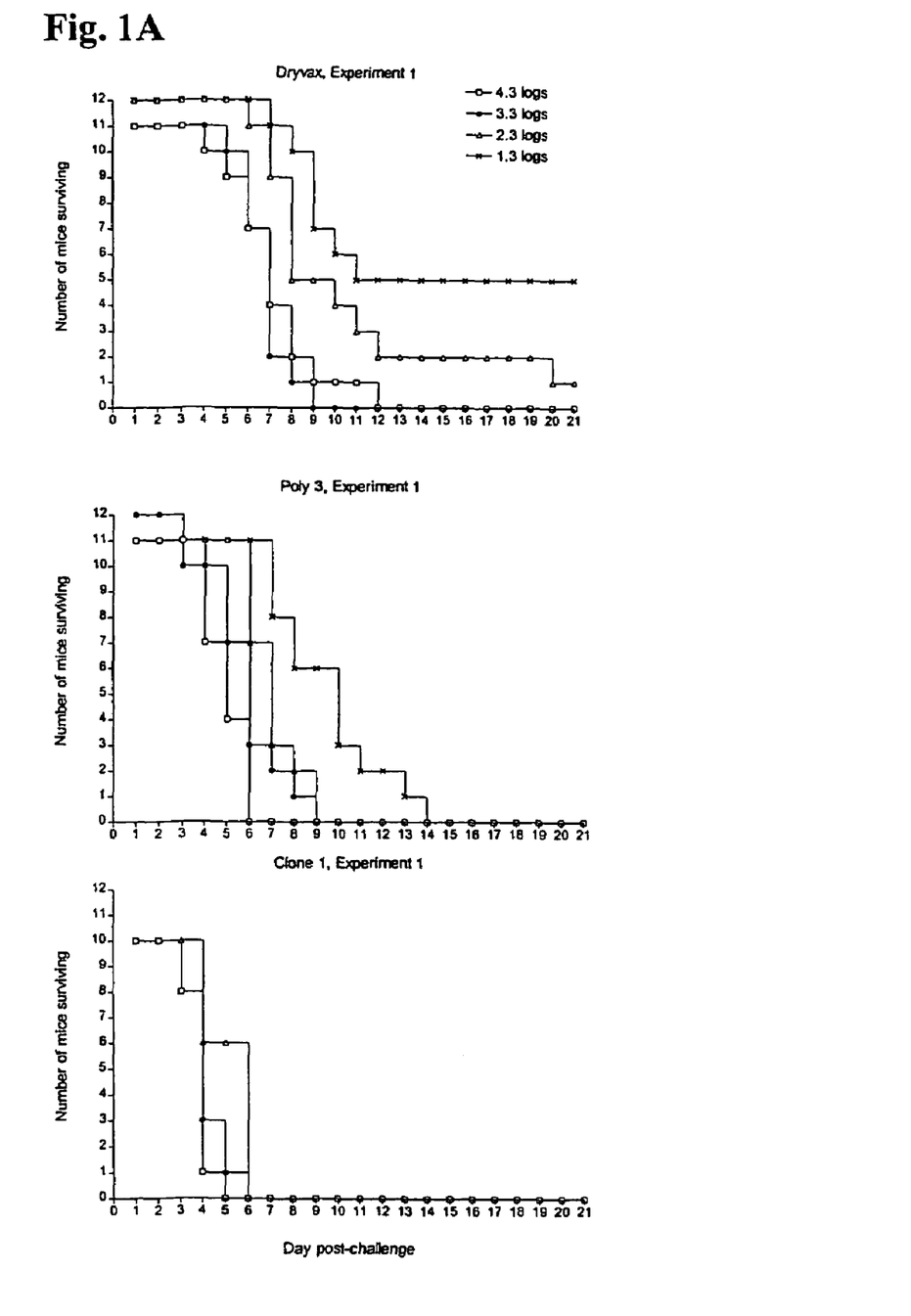
FIGS. 1A-1D are a series of graphs showing the results of experiments in which suckling mice were challenged with the indicated vaccinia clones, a polyclonal vaccinia virus preparation, or Dryvax®. The number of mice surviving and average survival time after these challenges are shown.
Figure 1B:
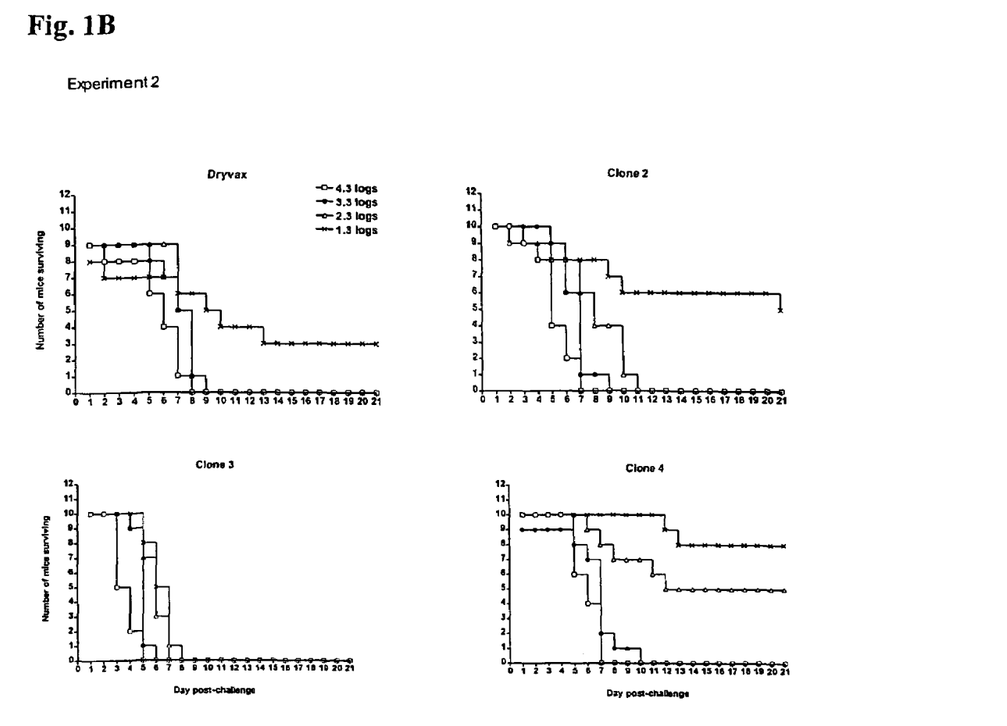
Figure 1C:
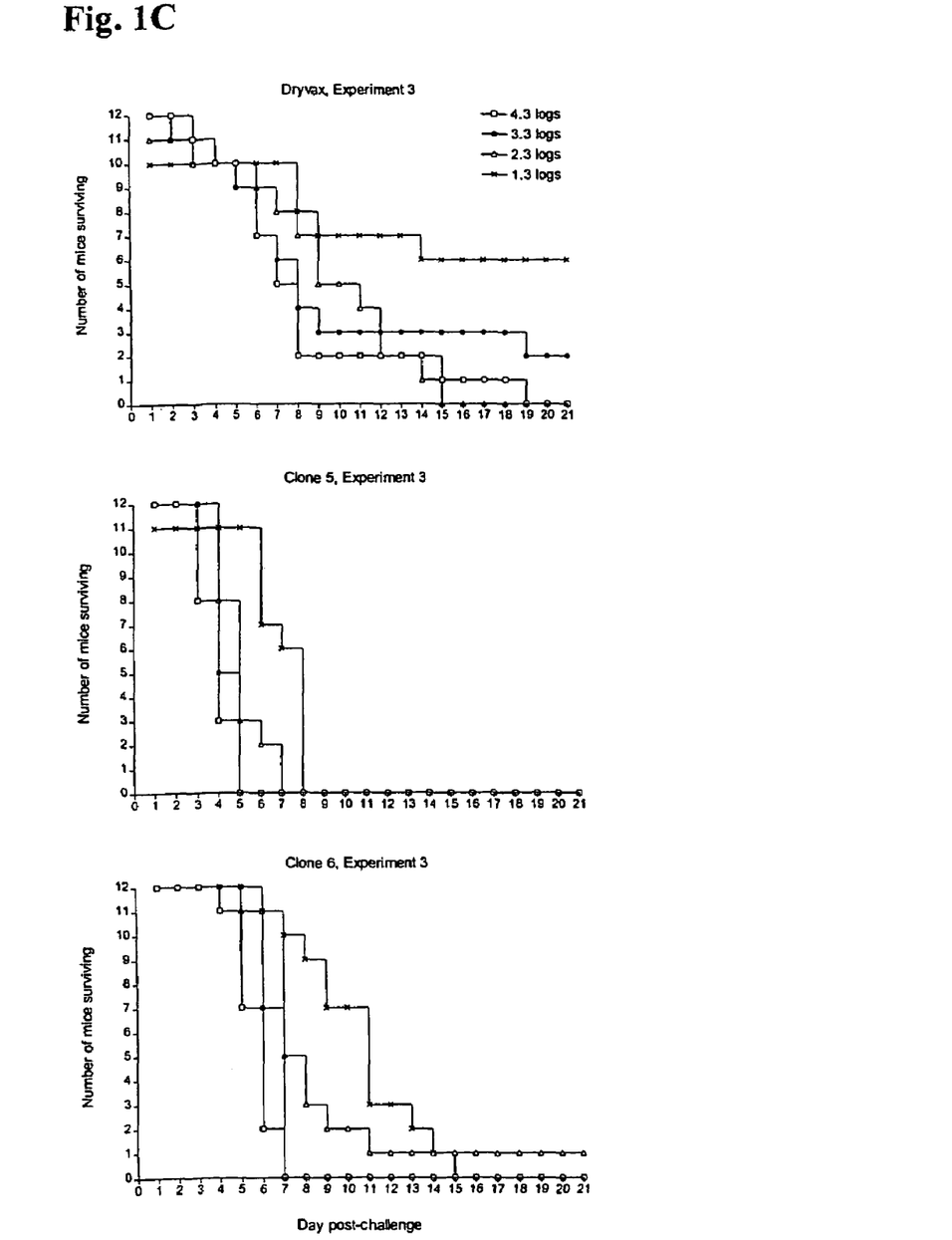
Figure 1D:
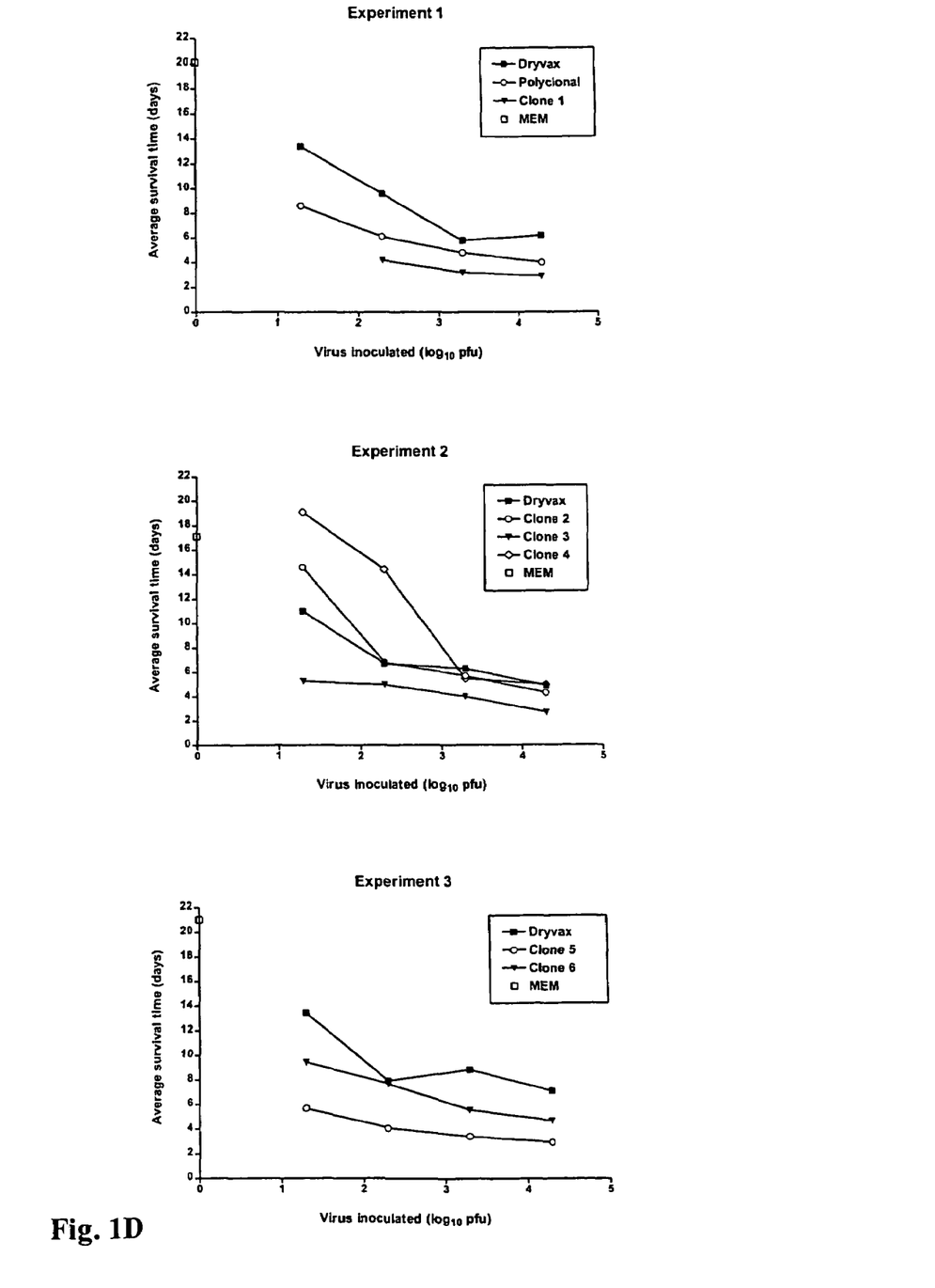
Figure 2:
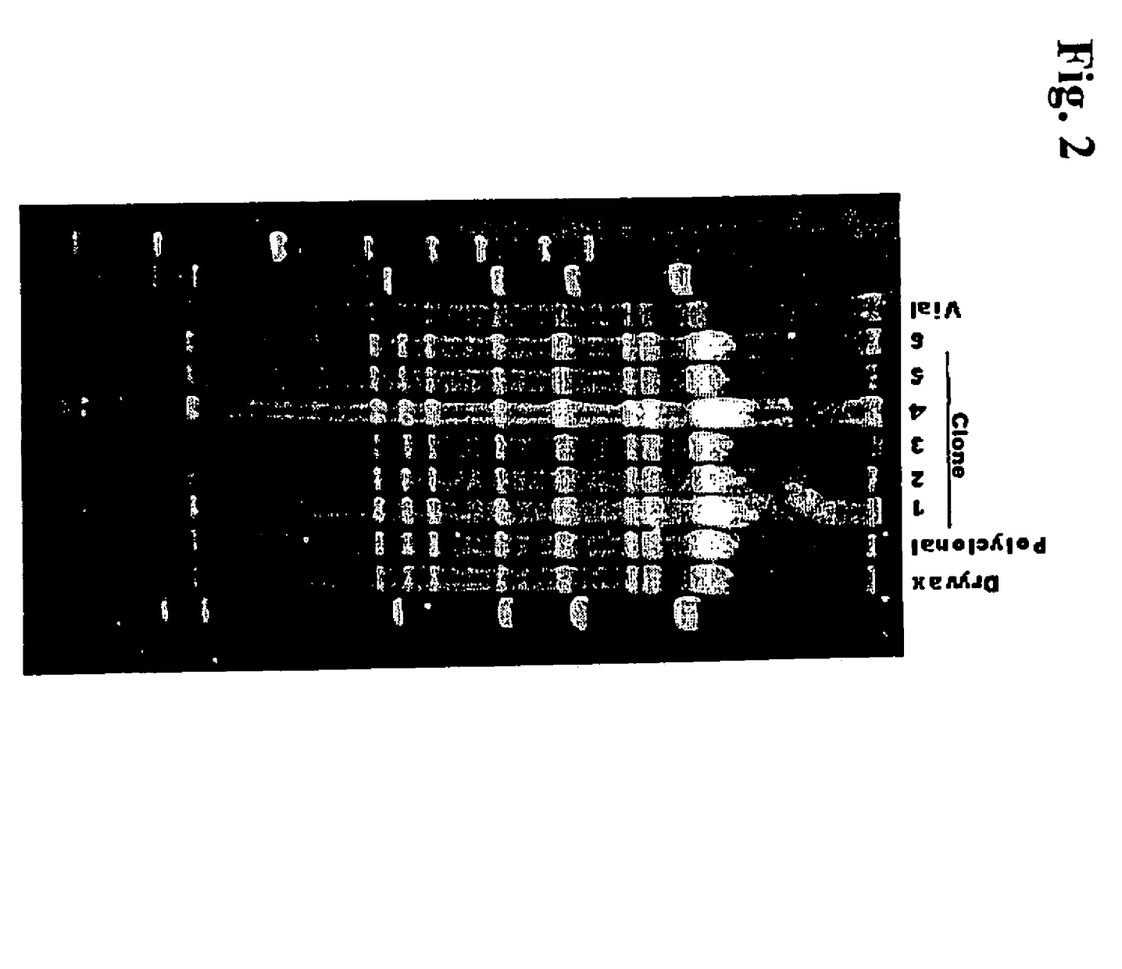
FIG. 2 shows a HindIII restriction enzyme digestion analysis of vaccine clones of the invention, as compared to a polyclonal virus preparation and Dryvax®.

DNA from Dryvax® and each vaccine candidate was purified and subjected to restriction endonuclease digestion by HindIII to determine whether there are genetic differences among the strains. No differences were detected, as is shown in the electrophoretic analysis of digested genomic DNA shown in FIG. 2.

Selection of a Cell Substrate

Studies of Dryvax® replication and yields in MRC-5 cells and primary chick embryo fibroblast (CEF) cells were undertaken, and showed yields to be lower in CEF cells than in MRC-5. MRC-5 cells were thus selected as the substrate for vaccine development. Candidates can be tested in CEF or other cells to compare vaccine yields.

Growth media for MRC-5 cell expansion were also compared. Williams E medium, Minimal Essential Medium (MEM), and Dulbecco's MEM gave equivalent results. Media enrichment with additional fetal bovine serum (FBS), nonessential amino acids, vitamins, and sodium pyruvate provided no advantages over medium with 10% FBS with respect to cell viability or growth. MRC-5 growth kinetics at appropriate cell seeding density was adequate. The cell plant density was determined to be $2\times10^4$ cells/$cm^2$. The time to split was determined to be 3-5 days, and the population doubling/split was determined to be 1-1.5. A method for producing cell banks and for cell expansion for virus growth was defined. Standard trypsinization methods were shown to be suitable for cell dissociation. An alternative method using bacterial pronase was shown to be useful, and may have the advantage of avoiding animal derived products in manufacturing.

Variants of ACAM1000/ACAM2000

The sequences of ACAM1000 and ACAM2000 are provided in SEQ ID NOs: 1 and 2, respectively. The coding sequences and corresponding protein sequences taken from the ACAM2000 sequence are provided in SEQ ID NOs:3-472 (also see the enclosed sequence appendices). Viruses that comprise these sequences, as well as compositions including them and methods employing them, are included in the present invention.

Also included in the invention are variants of these viruses, which have sequences that are similar to, but not identical to, those of the viruses. In particular, variant viruses of the invention can include nucleotide sequences that are, for example, at least 70%, 75%, 80%, 85%, 90%, 95%, 96%, 97%, 98%, or 99% (e.g., at least 99.2%, 99.5%, 99.7%, 99.8%, 99.9%, 99.95%, 99.99%, 99.995%, or 99.999%) identical to the sequences of SEQ ID NOs: 1 or 2. This level of identity can be throughout the entire sequences of the viruses, or can be within a particular region, such as, for example, any one (or more) of the coding sequences of SEQ ID NOs: 1 or 2 (or their complements). Thus, for example, any of the levels of identity noted above can be present in one or up to 235 of SEQ ID NOs:3-471 (odd numbers), in any combination.

The variant viruses can also include sequences that hybridize to the sequences of SEQ ID NOs: 1 or 2 (or their complements) under highly stringent conditions (see above). This criterion can be applied to the sequence of the variant virus as a whole, or to regions within the viral genomes, such as individual coding sequences. Thus, for example, virus variants of the present invention also include viruses that comprise one or up to 235 sequences that hybridize to the corresponding sequence in SEQ ID NOs: 1 or 2 under highly stringent conditions, in any combination.

Variant viruses of the invention can further be characterized as comprising sequences encoding one or up to 235 polypeptides of the sequences of SEQ ID NOs:4-472 (even numbers). Thus, the invention includes viruses that include sequences that are different from SEQ ID NOs: 1 or 2, but encode one or up to 235 of the same polypeptides as these sequences, due to the degeneracy of the genetic code. The variants can also include sequences that encode one or up to 235 of the polypeptides encoded by SEQ ID NOs: 1 or 2, but with conservative changes in the sequences (see above).

For all variants, it is preferable that the viruses have substantially the same virulence, immunogenicity, growth characteristics in culture, or restriction endonuclease digestion pattern as Dryvax®, ACAM1000, or ACAM2000, as discussed above. Assays for making these determinations are well known in the art, and examples are described above.

All references cited above are herein incorporated by reference. Other embodiments of the invention are within the following claims.

SEQUENCE LISTING (472 sequences)

SEQ ID NO: 1 - DNA, 202118 bp, vaccinia virus
  misc_feature 202067, 202075, 202104, 202105, 202106, 202107, 202108, 202109,202110, 202111: n = A,T,C or G
tgagaggactaaatatttttgtgtgacgtcgaaggagaaagagataaaacttttttacgactccatcagaaagaggtttaatatttttgtgagaccatcgaaggagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagaaagagatagttagtctagatatttttcttagtacaaaagtcaatgttttaaaatatatggacaagaatttgtctgtataaaaacttgtgtgaaattttgtaccaaagaaaaaatgtgagcagtatcccctacatggattttactagatcatttatataccaaaaaatattatacgatctacgttttattatatgattttaacgtgtaaattataaacattattttatgatatacaattgtctggtaacctagatgggcataggggatgttgataagctcgacgagtatatgttgttggacgttattgtttaagaaatagttgatgcatcagaaagagaataaaaaatattttagtgagaccatcgaagagagaaagagataaaacttttttacgactccatcagaaagaggtttaatatttttgtgagaccatcgaagagagaaagagaataaaaatattttatgactccattgaagagagaaagagaaaatgagaatgagaataaaaatattttagtgacaccatcagaaagaggtttaatatttttgtgagaccatcgaagagagaaagagaataaaaatattttatgactccattgaagagagaaagagaaaatgagaatgagaataaaaatattttagtgacaccatcagaaagaggtttaatattttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcagaaagaggtttaatatttttgtgataccctgaaaggaaataggaataggaataggaatagtgtcataatcgtatcacactattgagacagaaaaagaagaagtcgcgagaggtaactttttgtgaatgtagttaagaacatttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttgaatccatccttgacctcaagttcagatgattccttgcacatgtctccgatacgaacgctaaactctagattcttgacgcatttgtatcgacgatcgttgaaccgatgatatcttcgtaactcactttcttatgagagatgttagacccgagtactggatgggtcttgatgtcgctgtctttctcttcttcgctacatctgatgtcgatagacacctcacagtctttgatcatagcaagagcttcttcatgagtgatcgcgggagagtccttaccttgtcctggggacacgctggacaatctagcattcactgtgtttccatcagcggattctgagatggatttaatctgaggacatttggtgaatccaaagttcattctcagacctccaccgatgatggagtaataagtggtaggaggatctacatcctcgactgatgtggaatcatcttctgattccacctcgggatctggatctgactcggactctgtaatttccgttacggattggcaaatcttatcattggtcggtgtttggtcttgctttgtgactttgataataacatcgattcccatatgatgtttgttttcttcttccgtacacgaggaggaggattgctgaagactggcaggcacatgcatgccaggacgatatattgtttcatgattgctattgattgattactgttctttatgattctacttccttaccgtgcaataaattagaatatattttctacttttacgagaaattaattattgtatttatgggtgaaaaacttactataaaaagcgggtgggtttggaattagtgatcagtttatgtatatcgcaactaccgggcatatggctatcgacatcgagaacattacccacatgataagagattgtatcagtttcgtagtcttgagtattggtattactatatagtatatagatgtcgacgctagatagacagtctccgaatgcggcatgatagtatcattctttgctttcgttaactgtttggaggaagaatctttgttattgcatttaatctcgaaattcagagtgcacacctttctcctgtaaagaaacctgaagttgctaccttattaaggacagagaagtatccatcacgaaagacgggatcgcagtctttatgattcatagtaatagttagttccgacgttgagatggattcgctgagaccggtagtggtcgtccgagtacacgatgtgtcgttaactggatacaggttaatttccacatcgatatagttaaacgtatttctgggtacgggttcgcatttatctgcggaagagacggtgtgagaatatgttccgagaccacacggagaacagatgacgtctccggatactccgtatcctattccacattttgtttgggaaacacatgccttgcatccggatgatcctttgagaagacaataatatccgggagagcattcacagattctattgtgagtagtgttacacgatcgcatcttccgttacaacttagacaagcgggtaaatgattattgcgagatgtgaaggtacccgaaccacacggcgtacattgtgtgttagtcttgctatcgcataatctggaagcgtatgttcccggacacaaattatggcgtttgtattcgttgtctttacactttccatcggatggtgcatgcggtgctatatctcttccgtttattattatacatgagagaaacaatatatacgagtataatacggacttcataatttaataatgtagtaatcgttgtcttgttcctgtttcctacttctccaatcatatagatattttctttctatcatggataatatttgtaatggttctttccgtacaacatactgtttagatgatattgcgcataatttccggaggcaaatacgatagtctagattggccatcgatggtagactctaatttattgagtgctttgtcgacgagtttacttttacgctccatcgatagatggcactgttctatgagatcgtcgtacatgggaaatgaaatgtgactgtctgaatgtatggctttaagatagctgtgataccgtatacaggtcggtgtcggagattcgaatctctttaaggcgacttatgtcacgatgatggaatctatcttatcgaatgatatatttttcataaatacacttttatagtcctcgtttaaacagaatttactatgtagttccgcgaatgactcgtcccttaataggcagtaggctagtatcttttttacgtagtaatcgtcgtagggagagaattctgacatcttgtagaacaacgatttaatcataggtactttcagtctgtggtggatgatgtcattcacaacatccgccttgtatatgatgtttctgttttcaaacaccaagtcgaataccgtctttagtcggaaggttgatgtcgtatccgatgtatgaggcaacattgttgttacaattttgaaaggcggtattataatattcgtctttctgaatgtcgaacctatctagtagataccgtagtatattgagagtgtatccttgattatgttttatgaatagataaagtagatgttgtccttcttccttttgttcgtgccaattgagtaacattatgagaatatgacctgttgcacaatcgttccatgatgggtgtacaatcaagattattacgtatcctcgagataaaagagcatacaccacacgaggactatgtttggtatactgttgaaggtaagtgtgtaacggcgttaatgtttgctccataatctattatcgcgtagatgaatcgcttctcggctcgcatcttagtgtgacttgacttgtaataattgcttttgtagaacgtggatatgtgttacagtagtaatgaagagaagtgagtcatcctcgtcggcgcaattagggtcggatcctttgtacagaacgtaatagtttaagctcccattgaatttatatctaagataacacagcaatagatcggatgatttactaaagtcatcaatggtgtccgttagtatatcaaagatcttgttatcgattgatagtggtcatccttgctatcaaagttacgcatgccgtggtgtaacaatatctttaatacagatggattaaatcgtgtattcatcgtatagcaatgtaatggagagttacctcgtttattcagatcgcagtgtttaataactagcttaaacagatgagacgatgtatccacatcaaagaacgtaaaatacatatgacaaacattgttgacagaaacgtgaccttcattcttaccgtcgtccataaatacgttaggtatgtaccacatactgtcgcgaacgatgcgtacaatctcgtccatctcataatgatttactttttcataattaaagatgtgaaagaaaaccgaacaatatatttttttagtaatgtttatgcgagacatataaaataaactccgtgtttatgatgccggtaaatgtttttatcatcttggacggaatcgattttgtaatatgtcatggaaacaaatgaaacaggacattatcgctccatgataaattatttaatggagtaataaagtatctccatgggtaatttcgaaatcaagttatcgtctgtattaatgttgtccactatggagtcgatcctctcattgttctttacagtttctgtaatgatggacgttagttcttttttgtaccatttgatgtcggattctttgcgtatctcaatctgtggcgtttgcttcgtttaaataatatatcaaacatggagacgcctgatatgtaggcattcttcattctattaatgtctactctatagcgctttagttccttatgacgaccggcgatatcatactttactttagaaggaaaatcatcatctatgattaaggcgtatctgatacaggcgaataatggttcaggatatagatagcgtatatctctattaaatgcgtcaatcatagtctctagagtgggatggtagctaagtaataaatcaactagcttcgttttgttttctcttctgtaactacttttctggatggccgtattgattatcgagcgtgatgttgtaacactcgctccatattccaataaccgctttgcaaattgtatattattgacatcgaccgcgtaatatagtagagttttattctcattatcgatcatatctatattatccatgtacttgcttagtatatcaaatacatctattagtatggtttcataacagtgatacccgcaattattaaatctcgataatatcagaccgtacatacatagacggccattgttagatatgtgatttacagccgcgtgtccatattttccacgataaaccttacgacgtttacatcgacgagattattattaacaaagtagtcgtgcagaggatagttgttgtccgttatctaacatgcatcgaacgaccatatcgccgtaatgtaagtagtttatcaacatggcttgtacgatggattcatcctgttgtctaaatctctttagaatgttatcgatgatgtagtggttatattctctggaatcgtacgaagtaatactacgcattacgtcgacaagagtatgacgtctctcaataagaagattaacgatttccatgtctacattatatggggttactctaaatcgcttgtttagataatacgcctctaatatagggctgacgtcgtatactctacacgtgtccacatcctttattaataataatttaacaatctctatatctatggttgagaaagaccagtagtattggatgggtaaagatcctccttcgtctctgccatggatggaaacattgttattgatcaaacatttaattacatccttggatagagattgagattctctatgagacgatatatagtaatgaagagagttcttacacatatcactgttgtacatacaggtacgaaatacgtaaccggtgctgtaacattctgatttaagaagccatagcaatacttctggtctcggattaggcgtcgttacgtatatatccaccaatccgagaccattgattgcataattcgtattcttggacggacgtatccgtttatccacaattaggtattttagcagacgtaagtcgatattatccgaatacagatcgaaatcatttatattcgacttgagttcgttagaggaattcgaatagctggatatcagtagatgcacaatttgagatttgacgtatctatgcttactgtatactcctagcggagttaatccttcgttgtttctacaaagtctctcgactccgcgagagagtaacagtcgaacaatcttaatgtctgtatcgcatttattgaagacgtaacaatgtagcgcattgtttcctcgtctatctatatgttttgataagttgtgacacgtttcaatttctagttttatttttttgtacgtcacatcttcatccagtagacgacatagaatacatgtgcaatccatagctattctggtgctaattattcctatttcacgaaaaatgatgaaggcaatcattcctcataagatgataaaaagtgtagtgagagagcatgaaggagatttagtatttagcagtgcggatatgatccaagagggtgagatagtcgttctcgttcagaatctttcgcagcataagtagtatgtcgatatacttatcgttgaagactcttccagagacgatagctgattgagtacaaagtccaatgattgcacgaagttcttcggcggttttcatggagtcatttctgatgaaacatttaatgatctccacgcaattgtcgatattgtcccacggaagtgaatccttcaactcaccaccaaagagctccgttgcatcagttctgaaagagatgagaagcctgtagagaggccctgcagtttctctatgggtccatctatgagaaacccacaggatgtattcagtcagacaatgtctgacgtcggccacggtattcagggagtccttagtagcgtggcaatgacagggtctgaactgggcacaaggaaaggccattgtaaaggtagacctgtagccgtttatgctaatagagggctttaatttccatttttttaatgggttgtggatgaggaatgagagtgatatcatattgagatacgtagttatgtagaggtgtatttcctatattatttactttcggtttcatattttaccaactctttaataaatttcttttcacgatgcatcttattaaatgacgttttctcataagtggacatatagatgcagaagtaatgaagaaaagtattacctctatcatctgcataattagggtctgctccttttcttaacaacttatacagtacgtagtagtttatcggttttaaatcaagtctagaatatatagtggattaatatatttttatattagctaaagctatctatactatcagaaagcatatcattctcaacttcatcatgagttaaatatttgtgtaatggaatgtgaccatcactgtcatgacatactcctttaataggttttttaaaacagatgattcaaatccttcattcattagataacagtgtaacggagtcgtaccttctactagtttgtttatatcacagcattctacaaacagtctaaacaatagagaagacggacagactttaacgtataaatgacacatgttatcgatattcgttgatgaattattattaaacgtagttatgataaatgattctaacgacatctctcgctagagataaaatctagtatcgtatcattaaacatctttgcatcatactcgcatagcatagtttttcataattaatacaatatttaaaagacttattcggaaagtattttaatacatgtatcatcgatggagatccatatgaggagtcacttgtagttcttcagtagtaataacagtgctatcatcgatagtataattatatgtagaaggttcatatgttgttgtaattggagtaactgttggtagttcttccgtggaatcaataattatactaacagcaatagtataattatataaatatgttccgttgatatcacatattttaatgaactcatttctaacaccctcagctatatctgtccaattaaatgtagccaacaatctactacgttctctttgattgactacttgtacggtagcgacgctacactatctttattgtcttctacatgctccaattgaatgtcatgatacaacgcagtttttcttatgcatgtttcataacaccacgaacatgtcgcagtaagatatatagccagagataatttctgtaaattcatgattgccggtcataaacaagcccgtcaataattgtggctatatattcagtttatagagcaaaataattaagcacaatagcgcttaatctcaaaatatgttatgtttatttttttcatattaaacatactggttaaaatcctctaaaggctgatcttcatctataaatcaagatcataattacatttagacagtggtttcatgtttataaaaatgttctttttgtgtgaataaggaatatactaatcaataatcaaccatcgaccccattacgatagtatgcaggcaaccccccattagagaggtacgtgtaatcagtctctccagttttagtatttttataagtcattgttacataaacggcttttaaacagtctcctcgataataagccatatctggaaatttattaaatactcgagtcattttacgcacggtcaaaaaagtaagtaatgtcgacgacttcttacattctatagaaacacctagaatactcattttcttttggaaaatatcctcagactctgatttgaacaatgcacgacctatagtaaaccgtgaccaataagttatattagtcaatggtatatccaaaccatcaggtgtggatagtacgccgatagtccagtctttggtatcgatagtgtagttattgaactgagaagttaccgtatagtctttttggtcatctctaaacaaggaaactaatacctctacactattgaacgatttatcttccgtaatgggtggaataacgggaatataaagtggactagcgatggatgaagtcacgaatataagacacgctattaatccgtatatcatcattttgatattacttataataacgatttgtttaatttttagtttatactattaattgtaaatgatattattatttttttaagtattatcagctttagtttatactatttgtaatatttagacatagataaacgtgataaaagtctatttgtttatatttattgcggatagcagtatttccctataaaaagtatacgtcctgtgttgtctttaatcatgtacatgaatggatggtttatgtagaccttcgtacgatataccatcgaaaagttagtcataaatactcctgtaacggccgatgcttctgtatactcctcattaacatctataaacgtcgtatgtagaaatttttctacagtgatagtttcattacacatcttgctaaaatctgcataatatccgaatatattagtaagtcctaaattttctagaataggtaccagattatacggttctgtcatttccactttaaactttggcatatacaagtctatacttttagtagataacataccacaccattttttaaatttttcatctgttatatttttttctatgttatatataccttctatgtcgtccggtagtataatcaccatactagagtttccctcgtatggaatatcgataatagagaatcctccgaataattcattaatatgtacatattgcaagttattctcggtacccaccatcatatcaacgctggtaactatattcttagaaatataaaacttgtctgtatatgtaagatgtttagaaaatggatatttccacattgctttaaaatggacggcgctaacaactgtcatacgagtattaatggatagcggactagtcaataaggaattaattttaccatttgtcattgtcttaacccattcgttgattagttcctttgtttggttagcattattaaagtttacagtttgaaaatcgtcttttattttttgtaggaaggaggcatggaactcgatactatcgctaccgtatattttatttgcggtagctagtgtcgcacaatacggaatatctacgtccatgtcattattgtcatccttcttatcatcgggtgtattctcattcatattctctatatattttgatagttgttcagctgtagaaccagctgctccatgatttagaatagataaagtagataaaatggaaactggagaaatcaaaacattttcatcagggtgttttacgattagttctttaaagatatccatggtatagaccaaacaataacgataacgatatatatcataaataaataatgttaaatttcagtttatgtttgtaccccgtattcatacttaacaaattggtattacataccattaataatgcaagcataaaaaatcgttagtagatgtttctaaatataggttccgtaagcaaagaatataagaatgaagggtaatgataaaatcaatcgttatctaaaatgatcatactcatttattttattctattatattaacacatacatttttaacagcaacacattcaatattgtattgttatttttatattatttacacaattaacaatatattattagtttatattactgaattaataatataaaattcccaatcttgtcataaacacacactgagaaacagcataaacacagaatccatcaaaaatgtcgatgaaatatctgatgttgttgttcgctgctatgataatcagatcattcgccgatagtggtaacgctatcgaaacgacattgccagaaattacaaacgctacaacagatattccagctatcagattatgcggtccagagggagatggatattgtttacacggtgactgtatccacgctagagatatcgacggtatgtattgtagatgctctcatggttatacaggcattagatgtcagcatgtagtattagtagactatcaacgttcagaaaaaccaaacactacaacgtcatatatcccatctcccggtattatgcttgtattagtaggcattattattatgtgttgtctattatctgtttataggttcactcgacgaactaaactacctctacaagatatggttgtgccataatttttataaattttttttatgagtatttttacaaaaatgtataaagtgtatgtcttatgtatatttataaaaatgctaaatatgcgatgtatctatgttatttgtatttatctaaacaatacctctacctctagatattatacaaaaattttttatttcagcatattaaagtaaaatctagttaccttgaaaatgaatacagtgggtggttccgtatcaccagtaagaacataatagtcgaatacagtatccgattgagattttgcatacaatactagtctagaaagaaatttgtaatcatcttctgtgacgggagtccatatatctgtatcatcgtctagtttatcagtgtcccatgctatatttctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccatttttatcagtatgtatatctatatcaacgtcgtcgttgtagtgaatagtagttattgatctattatatgaaacggatatgtctagaacggcaattgtcttacgtccagttaacactttctttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtgttatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgtttttacgttgatttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccgatcggtaattgtctgccggtgtaatagaattatatatatctatctattacaccggccttgtatacataataataagttgtggtagtatgatctccatatttataatttaggactttgtattcagtatttttggaatcataaaaaataaaaaaaagttttactaatttaaaatttaaaaagtatttacatttttttcactgtttagtcgcggatatggaattcgatcctgccaaaatcaatacatcatctatagatcatgtaacaatattacaatacatagatgaaccaaatgatataagactaacagtatgcattatccgaaatattatatcaatatcacaaaaataaatccacatttggctaatcaatttcgggcctggaaaaaacgtatcgccggaagggactatatgactaacttatctagagatacaggaatacaacaatcaaaacttactgaaactatacgtaactgtcaaaaaaatagaaacatatatggtctatatatacactacaatttagttattaattggataaccgatgtgattatcaatcaatattaagaaggttggtaaattggtacatagctaataatacctatacacccaataatacaacaaccatttctgagttggatatcatcaaaatactggataaatacgaggacgtgtatagagtaagtaaagaaaaagaatgtggaatttgctatgaagttgtttactcaaaacgatagatactttggtttattggattcgtgtaatcatatattttgcataacatgtatcaatatatggcataaaacacgaagagaaaccggtgcgtcggataattgtcctatatgtcgtacccgttttagaaacataacaatgagcaagttctataagctagttaactaataaataaaaagtttaatttgttgacgacgtatgtcgttatttttctcgtatgaaagattaaattcaattcaattcgttgtttctaatataatctgccgtattggatggattctcaagacaattgcatttagattatatcataaataaaaatagtagcacacaactacttcagcaaacattctttttataaatgccatctatcgtagtgaggacacaagtgaacctataatgagcaaatttattagtatcggttacatgaaggactttctgtagagtgacgattctaccatctatggtacgaacggtttcatcttctttgatgccatcacccagatgttctataaacttggtatcctcgtccgatctcatatcctttgccaaccaatacatgtagctaaaattaggcataaatttcacacatccagtgcaacgaaattctccagaagatgttacgatgtttaggttaggacatttgatttcgtcggcattaacatatgggtgaacacacccatacatgaaggcgatgagaaataggattctcatcttgccaaaatatcactagaaaaaatttatttatcaattttaaaggtataaaaaatacttattgttgctcgaatattttgtatttgatggtatacggaagattagaaatgtaggtattatcatcaactgattctatggttttatgtattctatcatgtttcactattgcgttggaaataatatcatatgcttccacatatattttattttgttttaactcataatactcacgtaattctggattattggcatatctatgaataattttagctccatgatcagtaaatattaatgagaacatagtattaccacctaccattatttttttcatctcattcaattcttaattgcaaagatctatataatcattatagcgttgacttatggactctggaatcttagacgatgtacagtcatctataatcatggcatatttaatacattgttttatagcatagtagttatctacgatgttagatatttctctcaatgaatcaatcacataatctaatgtaggtttatgacataatagcattttcagcagttcaatgtttttagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagaccctttttgtatgtataagtgtaaaaattataacattcatagttggatttacataggtgtccaatcgggatctctccatcatcgagataattgatggcatctcccttccttttttagtagatatttcatcgtgtaagaatcaatattaatatttctaaagtatccgtgtatagcctctttatttaccacagttccatattccactagagggatatcgccgaatgtcatatactcaattagtatatgttggaggacatccgagttcattgttttcaatatcaaaaagatggtttccttatcatttctccatagtggtacaatactacacattattccgtgaggctttccattctccaaaaacaatttgaccaaatctacatctttattgtatctataatcactatttagataatcagccataattcctcgagtgcaacatgttagatcgtctatatatgaataagcagtgttatctattcctttcattaacaatttaacgatgtctatatctatatgagatgacttaatataatattgaagagctgtacaatagtttttatctataaaagacggcttgattccgtgattaattagacatttaacaacttccggacgcacatatgctctcgtatccgactttgaatacagatgcaatacggtaccgcaatttcgtagttgataatcatcatacgcgtatcagtactcgtcctcataaagaacactgcagccattttctatgaacaaatcaataattttaggaacaggatcattgtcattacataattttctataactgaacgatggttttcacatttaacactcaagtcaaatccatgttctaccaacacctttatcaagtcaacgtctacatttttggatttcatatagctgaatatattaaagtcatttatgttgctaaatccagtggcttctagtagagccatcgctatatcctttaactttaacatgtctactatttgtgtattcttctaatggggtagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctctcaacatctgtttaagttcatcgagagccacctcctcattttccaaatagtcaaacattttgactgaatgagctactgtgaactctatacacccacacaactaatgtcattaaatatcatgtcaaaaacttgtacaattattaataaaaataatttagtgtttaaattttaccagttccagattttacacctccgttaaccccactggacgatcctcctccccacattccaccgccaccagatgtataagttttagatcctttattactaccatcatgtccatggataaagacactccacatgccgccactaccccctttagaagacatattaataagacttaaggacaagtttaacaataaaattaatcacgagtaccctactaccaacctacactattatatgattatagtttctatttttacagtaccttaactaaagtctctagtcacaagagcaatactaccaacctacactattatatgattatagtttctatttttataggaacgcgtacgagaaaatcaaatgtctaatttctaacggtagtgttgataaacgattatcgtcaatggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccgtaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctggaatatatttatctgccagtataacacaaatagtaatacatgtaaacccatattttgttattatattaatgtctgtgccattatctattaaccattctactaggctgacactatgcgacttaatacaatgataaagtatactacatccatgtttatctattttgtttatatcattaatatacggcttacaaagttttagtatcgataacacatccaactcacgcatagagaaggtagggaataatggcataatatttattaggttatcatcattgtcattatttacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattaggatattattacgtaaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctctttttcgtgtgaaattaaatagtttatcacgtccaaagatgtagcataaccatcttgtgacctagtaataatataataatagagaactgttttacccattctatcatcataatcagtggtgtagtcgtaatcgtaatcgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttttctacaatattaataccatttttgatactatttatttctatacctttcgaaattagtaatttcaataagtctatatcgatgttatcagaacatagatattcgaatatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcaataagatcaatctctagatctatagaatcaaaacacgataggtcagaagataatgaatatctgtaggcttcttgttgtactgtaacttctcgttttgttagatgtttgcatcgtgctttaacatcaatggtacaaattttatcctcgctttgtgtatcatattcgtccctactataaaattgtatattcagattatcatgcgatgtgtatacgctaacggtatcaataaacggagcacaccatttagtcataacagtaatccaaaattttttaaagtatatcttaacgaaagaagttgtgtcattgtctacggtgtatggtactagatcctcataagtgtatatatctagagtaatgtttaatttatcaaatggttgataatatggatcctcatgacaatttccgaagatggaaatgagatatagacacgcaataaatctaattgcggacatggttactccttaaaaaaatacgaataatcaccttggctatttagtaagtgtcatttaacactatactcatattaatccatggactcataatctctatacgggattaacggatgttctatatacggggatgagtagttctcttctttaactttatactttttactaatcatatttagactgatgtatgggtaatagtgtttgaagagctcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaatttcttgtaatcattcgaaataatttttagtttgcatccgtagttatcccctttatgtaactgtaaatctctcaacgcgatatctccattaataatgatgtcgaattcgtgctgtatacccatactgaatggatgaacgaataccgacggcgttaatagtaatttactttttcatctttacatattgggtactagttttactatcataagtttataaattccacaagctactatggaataagccaaccatcttagtataccacacatgtcttaaagtttattaattaattacatgttgttttatatatatcgctacgaatttaaacagagaaatcagtttaggaaaaaaaattatctatctacatcatcacgtctctgtattctacgatagagtgctactttaagatgcgacagatctgtgtcatcaaaaatatactccattaaaatgattattccggcagcgaacttgatattggatatatcacaacctttgttaatatctacgacaatagacagcagtcccatggttccataaacagtgagtttatctttctttgaagagatattttgtagagatcttataaaactgtcgaatgacatcgcatttatatctttagctaaatcgtatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttggatgaatagtatgtcttaataattgttattattttcattaattaatatttagtaacgagtacactctataaaaacgagaatgacataactagttatcaaagtgtctaggacgcgtaattttcatatggtatagatcctgtaagcattgtctgtattctggagctattttctctatcgcattagtgagttcagaatatgttataaatttaaatcgaataacgaacataactttagtaaagtcgtctatattaactcttttattttctagccatcgtaataccatgtttaagatagtatattctctagttactacgatctcatcgttgtctagaatatcacatactgaatctacatccaattttagaaattggtctgtgttacatatctcttctatattattgttgatgtattgtcgtagaaaactattacgtagaccattttctttataaaacgaatatatagtactccaattatctttaccgatatatttgcacacataatccattctctcaatcactacatctttaagattttcgttgttaagatatttggctaaactatataattctattagatcatcaacagaatcagtatatatttttctagatccaaagacgaactctttggcgtcctctataatattcccagaaaagatattttcgtgttttagtttatcgagatctgatctgttcatatacgccatgattgtacggtacgttatgataaccgcataaaataaaaatccattttcatttttaaccaatactattcataattgagattgatgtaatactttgttactttgaacgtaaagacagtacacggatccgtatctccaacaagcacgtagtaatcaaatttggtgttgttaaacttcgcaatattcatcaatttagatagaaacttatactcatcatctgttttaggaatccatgtattattaccactttccattatcccaggctatgtttcgtccatcatcgttgcgcagagtgaataattcttttgtattcggtagttcaaatatataatccatgcatagatcggtaaagctattgtagatgtgatttttcctaaatctaatataaaactcgtttactagcaaacactttcctgatttatcgaccaagacacatatggtttctaaatctatcaagtggtggggatccatagttatgacgcagtaacatatattattacattcttgactgtcgctaatatctaaatatttattgttatcgtattggattctgcatatagatggcttgtatgtcaaagatatagaacacataaccaatttatagtcgcgctttacattctcgaatctaaagttaagagatttagaaaacattatatcctcggatgatgttatcactgtttctggagtaggatatattaaagtctttacagatttcgtccgattcaaataaattactaaataatatcccacattatcatctgttagagtagtatcattaaatctattatattttatgaaaaatatatcacttgctcacctctatatttcgtacatttttaaactgtttgtataatatctctctgatatatttattgtgtcggtagacgataccgttacatttgaattaatggtgttccattttacaacttttaacaagttgaccaattcatttctaatagtatcaaactctccatgattaaatattttaatagtatccattttatatcactacggacacaaagtagctgacataaaccattgtataatttttatgttttatgtttattagcgtacacattttggaagttccggctgccatgtatttcctggagagcaagtagatgatgaggaaccagatagtttatatccgtacttgcacttaaagtctacattgtcgttgtatgagtatgatcttttaaacccgctagacaagtatccgtttgatattgtaggatgtggacatttaacaatctgacacgtgggtggatcggaccattctcctcctgaacacaggacaccagagttaccaatcaacgaatatccactattgcaactataagttacaacgctcccatcggtataaaaatcctcgtatccgttatgtcttccgttggatatagatggaggggattggcatttaacagattcacaaataggtgcctcgggattccataccatagatccagtagatcctaattcacaatacgatttagattcaccgatcaaatgatatccgctattacaagagtacgttatactagagccaaagtctactccaccaatatcaagttggccattatcgatatctcgaggcgatgggcatctccgtttaatacattgattaaagagtgtccatccagtacctgtacatttagcatatataggtcccattttttgctttctgtatccaggtagacatagatattctatagtgtctcctatgttgtaattagcattagcatcagtctccacactattcttaaatttcatattaatgggtcgtgacggaatagtacagcatgatagaacgcatcctattcccaacaatgtcaggaacgtcacgctctccaccttcatatttatttatccgtaaaaatgttatcctggacatcgtacaaataataaaaaagcccatatatgtttgctattgtagaaattgtttttcacagttgctcaaaaacgatggcagtgacttatgagtttcatctttagtaaacatatcataatattcgatattacgagttgacatatcgaacaaattccaagtatttgattttggataatattcgtattttgcatctgctataattaagatataatcaccgcaagaacacacgaacatctttcctacatggttaaagtacatgtacaattctatccatttgtcttccttaactatatatttgtatagataattacgagtctcgtgagtaattccagtaattacatagatgtcgccgtcgtactctacagcataaactatactatgatgtctaggcatgggagacttttttatccaacgatttttagtgaaacattccacatcgtttaatactacatatttttcatacgtggtataaactccacccattacatatatatcatcgtttacgaataccgacgcgcctgaatatctaggagtaattaagtttggaagtcttatccatttcgaagtgccgtgtttcaaatattctgccacacccgttgaaatagaaaattctaatcctcctattacatataactttccatcgttaacacaagtactaacttctgattttaacgacgacatattagtaaccgttttccattttttcgttttaagatctacccgcgatacggaataaacatgtctattgttaatcatgccgccaataatgtatagacaattatgtaaaacatttgcattatagaattgtctatctgtattaccgactatcgtccaatattctgttctaggagagtaatgggttattgtggatatataatcagagtttttaatgactactatattatgttttataccatttcgtgtcactggctttgtagatttggatatagttaatcccaacaatgatatagcattgcgcatagtattagtcataaacttgggatgtaaaatgttgatgatatctacatcgtttggatttttatgtatccactttaataatatcatagctgtaacatcctcatgatttacgttaacgtcttcgtgggataagatagttgtcagttcatcctttgataattttccaaattctggatcggatgtcaccgcagtaatattgttgattatttctgacatcgacgcattatatagttttttaattccatatcttttagaaaagttaaacatccttatacaatttgtggaattaatattatgaatcatagtttttacacatagatctactacaggcgtaacatcaattattacggcagcaactagtatcatttctacattgtttatggtgatgtttatcttcttccagcgcatatagtctaatagcgattcaaacgcgtgatagtttataccattcaatataatcacttcatcatttatatggtgctcctgaatgcgtttaaaaaaattatacggagacgccgtaataatttccttattcacttgtataatttccccattgatagaaaatatcacgctttccattcttgaagtactataagtaattatagtataatgtaaaggtttatatattcaatattttttataaaaaaatcatttcgacattaattcctttttaaatttccgtctatcatctatagaaacgtattctatgaatttataaaatgcttttacgtgtcctatcgtaggcgatagaaccgctaaaaagcctatcgaatttctacaaaagaatctgttatatggtatagggagagtataaaacattaaatgcccgtacttattaaagtattcagtagccaatcctaactctttcgaatacttattaatggctcttgttctgtacgaatctatttttttgaacaacggacctagtggtatatcttgttctatgtatctaaaataatgtctgactagatccgttagtttaatatcctcagtcatcttgtctagaatggcaaatctaactgcgggtttaggctttagtttagtttttatatctacatctatgtctttatctaacaccaaaaatataatagctaatattttattacaatcatccggatattcttctacgatctcactaactaatgtttctttggttatactagtatagtcacgatcagacaaataaagaaaatcagatgatcgatgaataatacatttaaattcatcatctgtaagatttttgagatgtctcattaaaatattattagggttagtactcattatcattcggcagctattacttattttattatttttcaccatatagatcaatcattagatcatcaaaatatgtttcaatcatcctaaagagtatggtgaatgactcttcccatctaatttctgaacgttcaccaatgtctctagccactttggcactaatagcgatcattcgcttagcgtcttctatattattaactggttgattcaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgattagttaacaactattttttatgttaaatcaattagtacaccgctatgtttaatacttattcatattttagtttttaggattgagaatcaatacaaaaattaatgcatcattaattttagaaatacttagtttccacgtagttaatgaaacatttgaactcatcgtacaggacgttctcgtacaggacgtaactataaaccggtttatatttgttcaagatagatacaaatccgataacttttttgacgaattctacgggatccactttaaaagtgtcataccgggttctttttatttttttaaacagatcaatggtgtgatgttgattaggtcttttacgaatttgatatagaatagcgttcacatatcctccataatggtcaatcgccatttgttcgtatgtcataaattctttaattatatgacactgtgtattgtttagttcatccttgttcattgttaggaatctatccaaaatggcaattatactagaactataggtgcgttgtatacacatattgatgtgtctgtttatacaatcaatgatatttggatccatgctactaccttcgggtaaaattgtagcatcatataccatttctagtactttaggttcattattatccattgcagaggacgtcatgatcgaatcataaaaaaatatattatttttatgttattttgttaaaaataatcatcgaatacttcgtaagatactccttcatgaacataatcagttacaaaacgtttatatgaagtaaagtatctacgatttttacaaaagtccggatgcataagtacaaagtacgcgataaacggaataataatagatttatctagtctatctttttctatagctttcatagttagatacatggtctcagaagtaggattatgtaacatcagcttcgataaaatgactgggttatttagtcttacacattcgctcatacatgtatgaccgttaactacagagtctacactaaaatgattgaacaatagatagtctaccattgttttgtattcagatagtacagcgtagtacatagcatcttcacaaattatatcattgtctaatagatatttgacgcatcttatggatcccacttcaacagccatcttaaaatcatattgctttcctttatcattaataatttctagaacatcatctctatcataaaagatacaaatattaactgtttgatccgtaataacattgctagtcgatagcaatttgttaataagatgcgctaggctcaatgtcttaataagaagtgtaagaggactatctccgaatttgttttgtttattaacatccgttgatggaagtaaaagatctataatgtctacatacttaactgttttagagcatacaatatggagaggtgtatttccatcatgatctggttttgagggactaattcctagtttcatcatccatgagattgtagaagcttttggattgtctgacataagatgtctatgaatatgatttttgccaaatttatccactatcctggcttcgaatccgatggacattatttttttaaacactctttctgaaggatctgtacacgccaacaacggaccacatccttcttcatcaaccgagttgttaatcttggctccatactgtaccaataaatttattctctctatgacttcatcatctgttcccgagagataatatagaggtgttttattatgtttatcacacgcgtttggatctgcgccgtgcgtcagcagcatcgcgactattctattattattaattttagaagctatatgcaatggataatttccatcatcatccgtctcatttggagagtatcctctatgaagaagttcttcgacaaatcgttcatctagtcctttaattccacaatacgcatgtagaatgtgataattatttccagaaggttcgatagcttgtagcatattcctaaatacatctaaatttttactattatatttggcataaagagatagataatactcggccgacataatgttgtccattgtagtataaaaattaatatttctatttctatttctgtatatttgcaacaatttactctctataacaaatatcataacttagttcttttatgtcaagaaggcactggtttagttcatctataaatgtcacgccataactaccacgcatgccatactcagaattatgataaagatatttatccttggggtgtaggtaatggggattaatctttgttggatcagtctctaagttaacacatgtcacacatgatccatttatagttatatcacacgatgatgatttatgaattgattccggaagatcgctatcgtattttgtggttccacaattcatttccatacatgttattgtcacactaatattgtgatgaactttatctagccgctgagtggtaaacaacagaacagatagtttattatctttaccaacaccctcagccgctgccacaaatctctgatccgtatccatgatggtcatgtttatttctagtccgtatccagtcaacactatgttagcatttctgtcgatatagctttcactcatatgacactcaccaataatagtagaattaatgtcataatttacaccaatagtgagttcggcggcaaagtaccaataccggtaatcttgtcgaggaggacatatagtattcttgtattctaccgaatacccgagagatgcgatacaaaagagcaagactaatttgtaaaccatcttactcaaaatatgtaacaatagtacgatgcaatgagtaagacaataggaaatctatcttatatacacataattattctatcaattttaccaattagttagtgtaatgttaacaaaaatgtgggagaatctaattagtttttctttacacaattgacgtacatgagtctgagttccttgtttttgctaattatttcatccaatttattattcttgactatatcgagatcttttgtataggagtcagacttgtattcaacatgcttttctataatcattttagctatttcggcatcatccaatagtacattttccagattagcagaatagatattaatgtcgtatttgaacagagcctgtaacatctcaatgtctttattatctatagccaatttaatgtccggaatgaagagaagggaattattggtgtttgtcgacgtcatatagtcgagcaagagaatcatcatatccacgtgtccattttttatagtgatgtgaatacaactaaggagaatagccagatcaaaagtagatggtatctctgaaagaaagtaggaaacaatacttacatcattaagcatgacggcatgataaaatgaagttttccatccagttttcccatagaacatcagtctccaatttttcttaacaaacagttttaccgtttgcatgttaccactatcaaccgcataatacaatgcggtgtttcccttgtcatcaaattgtgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgtatctttactagagagaaagcttttcagctgcttagacttccaagtattaattcgtgacagatccatgtctgaaacgagacgctaattagtgtatattttttcattttttataattttgtcatattgcaccagaattaataatatctctaatagatctgattagtagatacatggctatcgcaaaacaacatatacacatttaataaaaataatatttattaagaaaattcagatttcacgtacccatcaatataaataaaataatgattccttacaccgtacccatattaaggagattccaccttacccataaacaatataaatccagtaatatcatgtctgatgatgaacacaaatggtgtattaaattccagtttttcaggagatgatctcgccgtagctaccatgatagtagatgcctctgctacagttccttgttcgtcgacatctatctttgcattctgaaacattttataaatatataatgggtccctagtcatatgtttaaacgacgcattatctggattaaacatactaggagccatcatttcggctatcgacttaatatccctcttattttcgatagaaaatctagggagtttaagattgtacactttattccctaattgaaacgaccaatagtctaattttgcagccgtaatagaatctgtgaaatgggtcatattatcacctattgccaggtacatactaatattagcatccttatacggaaggcgcaccatatcatattcttcgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatacacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgcagacgataggtagacactgaacacgttaacgatagtatcaataacgcaatcatgattttatggtattaataattaaccttatttttatgttcggtataaaaattattgatgtctacacatccttttgtaattgacatctatatatccttttgtataatcaactctaatcactttaacttttacagttttccctaccagtttatccctatattcaacatatctatccatatgcatcttaacactctccgccaagatagcttcaaagtgaggatagtcaaaaagataaatatatagagcataatcattctcgtatactctgccctttattacatcacccgcattgggcaacgaataacaaaatgcaagcatcttgttaacgggctcgtaaattgggataaaaattatgtttttatatctattttattcaagagaatattcaggaatttctttttccggttgtatctcatcgcagtatatatcatttgtacattgtttcatattttttaatagtttacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatataggccgttttatcggttaccatatatttggcatggtttaccctagaatacggaatgggaggatcagcatctggtacaataaatagctttacttctatatctatgtttttagattttagcatagcgatagatcttaaaaagtttctcatgataaacgaagatcgttgccagcaactaatcaatagcttaacggatacttgtctgtctatagcggatcttcttaattcatcttctatataaggccaaaacaaaattttacccgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacaccacttacgttaatactaagaggatgatctgtattataatacgacggataaaagtttttcccattatatggtagattgttaactccaagataccagtatacctcaaaaatttgagtgagatccgctgccaagttcctattattgaagatcgcaatacccaattctttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattgacggctactctaactcttactcctcttttgggtaattgtaccatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtctctgtaatcactgcgattgtattatccggattcattttatttgttaaaaaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctgaaacatcactaatctcattgtttgttccctggagtatgagagtcggggggtgttaatcttggaaattatttttctaaccttgttggtagccttcaagacctgactagcaaatccagccttaattttttcatgattgattaatgggtcgtattggtatttataaactttatccatatctctagatactgattctggacatagctttccgactggcgcatttggtgtgatggttcccataagtttggcagctagcagattcagttttgaaacagcatctgcattaactagaggagacattagaatcattgctgtaaacaagtttggattatcgtaagaggctagtatagaaattgttgctcccatggaatgacccaataagtagatttaatagttaccacgtgctgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaataggtttccaatatatgtaatcattgtccagattgaacatacagtttgcattcatgattcacgttatataactatcaatattaacagttcgtttgatgatcatattatttttatgttttattgataattgtaaaaacatacaattaaatcaatatagaggaaggagacggctactgtcttttgtgagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtctattcgctaccataggaatatgtgctaaaatcactgaacattggggatacaaaaagatttcagaatctagattccaatcattgggaaacattacagatctgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaatttggttataaatgaaattgtcgccaatcttacacccaaccccttgttatccattagtatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcatgtactataccattatctatatcatctacataatctacgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcaaatcttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgattcacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatggatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttacagctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatctatttcttcgctttatataccacttaatgacaaaatcaactacataatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaagataaagtttatacaagtgtagatgataaattctacagaggttaatatagaagcacgtaataaattgacgacgttatgactatctatatatacctttccagtatacgagtaaataactatagaagttaaactgtgaatgtcaaggtctagacaaaccctcgtaactggatctttatttttcgtgtatttttgacgtaaatgtgtgcgaaagtaaggagataactttttcaatatcgtagaattgactattatattgccacctatagcatcaataattgttttgaatttcttagtcatagacaatgctaatatattcttacagtacacagtattaacaaatatcggcatttatgtttctttaaaagtcaacatctagagaaaaatgattatctttttgagacataactcccattttttggtattcacccacacgtttttcgaaaaaattagtttttccttccaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggatactgcatctgttataatatatctaacggtttcttcactcggtggatacaataaatgtttaaacatcaaacatgcgaaatcgcagtgcagaccctcgtctctactaattagttcgttggaaaacgtgagtccgggcattaggccacgctttttaagccaaaatatggaagcgaatgatccggaaaagaagattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcataatattggattgggaaaataacaaatctatttggatttggtgcaaggatgggttccataactaaattaacaatatcaataaattttttttcagttatctatatgcctgtacttggattttttgtacatcgatatcgccgcaatcactacaataattacaagtattattgatagcattgttattagtactatcataattaaattatcgacattcatgggtgctgaataatcgttattatcatcattatcattttgtaattgtgacatcatactaaataaatcgtttgcgagattgttgtgggaagcgggcatggaggatgcattatcattattatttaacgccttccatttggattcacaaatgttacgcacattcaacattttatggaaactataattttgtgaaaacagataacaagaaaactcgtcatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgttagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaattcattttcaattataatatactggtaatgaccattaaaataaaaatattcttcataaccggtaagaaagtgaaaagttcacattgaaactatgtcagtagtatacatcatgaaatgatgatatatatatactctattttggtggaggattatatgatataattcgtggataatcatttttaagacacatttctttattcgtaaatcttttcacgttaaatgagtgtccatattttgcaatttcttcatatgatggcggtgtacgtggacgaggctgctcctgttcttgttgtggtcgccgactgtcgtgtctgcgtttagatccctccattatcgcgattgcgtagatggagtactattatataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttggccgggcggagccgaacattctccgatatccaatttctgtatatctataatattattaacctccgcatacgcattacagttcttttctagcttggatactacactaggtacatcatctagatctattcctatttcctcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgttttggtacacatgatgaattcttctaatgctgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcagcatggtagttcgtaaattttaatgtataacagagccatctgtaaaaagataaactttatgtattgtaccaaagatttaaatcctaatttgatagctaactcggtatctactttatctgcagaatacagtgctaggggaaaaattataatatttcctctttcgtattcgtagttagttctcttttcatgttcgaaaaagtgaaacatgcggttaaaatagtttataacattaatattactgttaataactgccgggtaaaagtgggatagtaatttcacgaatttgatactgtcctttctctcgttaaacgcctttaaaaaaactttagaagaatatctcaatgagagttcctgaccatccatagtttgtatcaataatagcaacatatgaagaacccgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccctattaaaattcttaaaataatttaacaatctaactgacggagcccaattttggtgtaaatctaattgggacattatattgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaactattaactattttgtctctgtttttaatttctttagtaatgaaattattcacaatatcagtatcttctttatctaccagagattttactaacttgataaccttggctgtctcattcaatagggtagtaatatttgtatgtgtgatattgatatctttttgaattgtttcttttagaagtgattctttgatggtgccagcatacgaattacaataatgcagaaactcggttaacatgcaggaattatagtaagccaattccaattgttgcctgtgttgtattagagtgtcaatatgagcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctactgacgatagtatctccttgacagatattggaccgaattacagaagtacctggaatgtaaagccctgaaaccccctcattttttaagcagattgttgccgtaaatcctgcactgtgaccaagatagagagctcctttggtgaatccatctctatgtttcagtttaaccaagaaacagtcagctggtctaaaatttccatctctatctaatacagcatctaacttgatgtcaggaactatgaccggtttaatgttatatgtaacattgagtaaatccttaagttcataatcatcactgtcatcagttatgtacgatccaaacaatgtttctaccggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcaatggaatgcaaaaccccatagtgaaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtatagaacaacgaaattatactagagttgttaaagttaatattttctatgagctgttccaataaattatttgttgtgactgcgttcaagtcataaatcatcttgatactatccagtaaacagtctttaagttctggaatattatcatcccattgtaaagcccctaattcgactatcgaatatcctgctctgatagcagtttcaatatcgacggacgtcaatactgtaataaaggtggtagtattgtcatcatcgtgataaactactggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattatttactataatataatctagacagatagatgattcgataaatagaaaaggtatatcgttggtaggataatacatccccattccagtattctcggatactctattaatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacagttattgggccagtatactgttagcaacggtatatcgaatagattactcatgtaacctactagaatgatagttcgtgtactagtcataatatctttaatccaatctaagaaatataaaattagatcttttacactgttaaagttaacaaaggtattacccgggtacgtggatatcatatatggtattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagagaacttacgatacatctgtttcctgtaatcgttaaattttacaaatctataacatgctaaaccttttgacgacaaccattcattaatttctgatatggaatctgtattctcgataccgtattgttctaaagccagtgctatatctccctgttcgtgggaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatcttgtaatattcatcatcgacataatactatctatgttatcatcgtatattagtataccatgaccttcttcatttcgtgccaaaataatatacagtcttaaataattacgcaatatctcaatagtttcataattgttagctgttttcatcaaggtttgtatcctgtttaacatgatggcgttctatacgtttctattttctattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcgtctagacttctggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagctgacctgagtttatcaataactacatcggtatctaaatctctagaatatcccaataggtgttccggagaatcagtaaagaacactccacctataggattcttaatatgatacgcagtgctaactggcaaacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcatcatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccgatgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtttatttctatatccgtatccattgtagattgttgaccgattatcgagtttaaatcattactaatactcaatccttcagaatacaatctgtgtttcattgtaaatttataggcggtgtatttaagttggtagattttcaattatgtatcaatatagcaacagtagttcttgctcctccttgattctagcatcctcttcattattttcttctacgtacataaacatgtccaatacgttagacaacacaccgacgatggcggccgccacagacacgaatatgactaaaccgatgaccatttaaaaacccctctctagctttcacttaaactgtatcgattattcttttagaacatgtataatataaaaacattattctatttcgaatttaggcttccaaaaatttttcatccgtaaaccgataataatatatatagacttgttaatagtcggaataaatagattaatgcttaaactatcatcatttccacgattagagatacaatatttacattttttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatccttttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacaaatcgtcgaaaactagttatagttaacattttattatttgataccctgatattaatacccctgccgttactattatttataactgatgtaacccacgtaacattagaattaattatcgatagtaatgcatcaacgcttccaaaattgtctattataaactcaccgataatttttttattacatgttttcatattcattaggattatcaaatctttaatcttactacgattgtatgcgttgatattgcaagacgtcattctaaaagacggaggatctccatcaaatgccaaacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacactagtcacaatcaccactttcatatttagaatatatgtatgtaaaaatatagtagaatttcattttgtttttttctatgctataaatgaattctcattttgcatctgctcatactccgttttatatcaataccaaagaaggaagatatctggttctaaaagccgttaaagtatgcgatgttagaactgtagaatgcgaaggaagtaaagcttcctgcgtactcaaagtagataaaccctcatcacccgcgtgtgagagaagaccttcgtccccgtccagatgcgagagaatgaataaccctggaaaacaagtcccgtttatgagaacggacatgctacaaaatatgttcgcggctaatcgcgacaacgtggcgtcgagacttttgaactaaaatacaattatatctttttcgatattaataaatccgtgtcgcccgggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtgacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtgataaattttattagaaaggccaaatctataagaaaagtcctagaattagtctgaagaatatctatatcgccgtatagtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtatcaacatcggaaaaaaatctttttttattcttttttactaaagatacaaatatgtctttgttaaaaacagttattttctgaatatttctagcttgtaattttaacatatgatattcgttcacactaggtactctgcctaaataggtttctataatctttaatgtaatattaggaaaagtattctgatcaggattcctattcattttgaggatttaaaactctgattattgtctaatatggtctctacgcaaactttttcacagagcgatagagtttttgataactcgtttttcttaagaaatataaaactactgtctccagagctcgctctatcttttattttatctaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaattttattcttcgctcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttgtttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatatttcttaatgtaaagagtgatcaaatcattgtgtttattgtaccatcttgttgtaaatgtgtattcggttatcggatctgctcctttttctattaaagtatcgatatcgatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtattttgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacttgatgttcatatattggttcatacatgaaatgatctctattgatgatagtgactatttcgttctctgaaaattggtaactcattttatatatgctttccttgttgatgaaggataggatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacgaattctacaacattattataaaggactttgggtagataagtgggatgaaatcctattttaattaatgctatcgcattgtcctcgtgcaaatatccaaacgcttttgtgatagtatgacattcattatctagaaacgctctacgaatatctgtcacagatatcatctttagagaatactagttgcgttaatagtactaaaatttgtattttttttaatatatctcaaaaaaaattaatatttatggatccgatgtataattagaatcagaatctaatgatgacgtacccaagaagtttatctacagccaatttagctgcattatttttagcatctcgtttagattttccatcggccttatcgaatactcttccgtcgatatctacacaggcataaaatgtaggagagttactaggcccaactgattcaatacgaaaagaccaatctctcttagttatttggcagtactcattaataatggtgacagggttagcatctttccaatcaataatttttttagccggaataacatcatcaaaagacttatgatcctctctcattgatttttcgcgggatacatcatctattatggcgtcagccataacatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatgtttttaatagccgcacacacaatctctgcgtcagaacgctcgtcaatatagatcttagacatttttagagagaactaacacaaccagcaataaaactgaacctactttatcatttttttattcatcatcctctggtggttcgtcgttcctatcgaatgtggatctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcatgtctaactagtggaggttcgtcagcggctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatatgttaataattgtattgtggttatacggctacaatttcataatgagtggaagtcagtgtccgatgatcaatgacgatagctttactctgaaaagaaagtatcaaatcgatagtgcggagtcaacaatgaaaatggataagaagaggacaaagtttcagaatagagccaaaatggtaaaagaaataaatcagacaataagagcagcacaaactcattacgagacattgaaactaggatacataaaatttaagagaatgattatgactactactctagaagatatagcaccatctattccaaataatcagaaaacttataaactattctcggacatttcagccatcggcaaagcatcacggaatccaagtaagatggtatatgctctgctgctttacatgtttcccaatttgtttggagatgaccatagattcattcgttatagaatgcatccaatgagtaaaatcaaacacaagatcttctctcctttcaaacttaatcttattagaatattagtggaagaaagattctataataatgaatgcagatctaataaatggaacacaagttgataaaatgttgatagctgaatctgataaatatacaatagatgcaaggtataacctaaaacccatgtatagaatcaagggagaatctgaagaagataccctcttcatcaaacagatggtagaacaatgtgtgacatcccaggaattggtggaaaaagtgttgaagatactgtttagagatttgttcaagagtggagaatacaaagcatacagatacgatgatgatgtagaaaatggatttattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagtgataaaatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcttacctaagcaagaaagatacaggcatagagtttgcggataatgatagacaagatatatacactctatttcaacaaactggtagaatagtccatagcaatctaacagaaacgtttagagattatatctttcccggagataagactagctattgggtgtggttaaacgaaagtatagctaatgatgcggatattgttcttaatagacacgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgataaaacgtttaacgaggacttattcagagttgttgttcaaataaatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttgagagataatctatatcatgtagaagaattcttggataaaagcatccatctaaccaagacggataagaaatatatacttcaattgataagacacggtagatcatagaacagaccaaatatattattaataatttgtatatacatagatataattatcacatattaaaaattcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcggagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattagcatcttattagaatattaacctaactaaaagacataacataaaaactcattacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacctagatgctagtgactattatcccatttcgttgggattacttaaaaagtttgagtttctcatgtctctatataaaggtcctattcccgtatatgaagaaaaagtaaatactgaattcattgctaatggatctttctccggtagatatgtatcatatcttagaaagttttctgctcttccaacaaacgagtttattagttttttgttactgacttccattccaatctataatatcttgttctggtttaaaaatactcagtttgatattactaaacacacattattcagatacgtctatacagataatgccaaacacctggcgttggctaggtatatgcatcaaacaggagactataagcctttgtttagtcgtctcaaagagaattatatatttaccggtcccgttccaataggtatcaaagatatagatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtttcatatgttttaatatttacaagttttttggtccatggtccattaggacaaatatatgcaaaataatatcgttctccaagttctatagtctctggattatttttattatattcagtaaccaaatacatattagggttatctgcggatttataatttgagtgatgcattcgactcaacataaataattctagaggagacgatctactatcaaattcggatcgtaaatctgtttctaaagaacggagaatatctatacatacctgattagaattcatccgtccttcagacaacatctcagacagtctggttttgtacatcttaatcatattcttatgaaacttggaaacatctcttctagtttcactagtacctttattaattctctcaggtacagattttgaattcgacgatgctgagtatttcatcgttgtatatttcttcttcgattgcataatcagattcttatataccgcctcaaactctattttaaaattattaaacaatactctattattaatcagtcgttctaactctttcgctatttctatagacttatcgacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttaacatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaatagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacataatagtacgactttaaatccattttcccaaatatctttacgaattactttacatataatatcctcatcaacagtcacataattacctgtggttaaaacctttgcaaatgcagcggctttgcctttcgcgtctgtagtatcgtcaccgatgaacgtcatttctctaactcctctatttaatactttacccatgcaactgaacgcgttcttggatatagaatccaatttgtacgaatccaatttttcagatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataatcttctctcctgttaataactctagacgattagtaatatatctcagatcaaagttatgtccgttaaaggtaacgacgtagtcgaacgttagttccaacaattgtttagctattcgtaacaaaactatttcagaacatagaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtaactacgtaataaaagtaatgaggaaatcgtataaatacggtctcaccatttcgacatctggatttcagatataaaaatctgttttcaccgtgactttcaaaccaattaatgcaccgaacatccatttctagaatttagaaatatattttcatttaaatgaatcccaaacattggggaagagccgtatggaccattatttttatagtactttcgcaagcgggtttagacggcaacatagaagcgtgtaaacgaaaactatatactatagtcagcactcttccatgtcctgcatgtagacggcacgcgactatcgctatagaggacaataatgtcatgtctagcgatgatctgaattatatttattattttttcatcagattatttaacaatttggcatctgatcccaaatacgcaatcaatgtgtcaaaggttaaccctttataaacttaacccattataaaacttatgattagtcacaactgaaataaccgcgtgattattttttggtataattctacacggcatggtttctgtgactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacagatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgtccaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatagagtgtccgtataccaacatgtctgatattttgatgtattccattaaattatttagttttttctttttattttcgttaaacagcatttctgtcaacggaccccaacatcgttgaccgattaagttttgattgatttttccgtgtaaggcgtatctagtcagatcgtatagcctatccaataatccatcatctgtgcgtagatcacatcgtacactttttaattctctatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacagggattaagacggaaagatgaaatgattctctcaacatcttcaatggataccttgctattttttctggcattatctatatgtgcgagaatatcctctagagaatcagtatcctttttgatgatagtggatctcaatgacatgggacgtctaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatctacatcagttttgtattccaaattaaacatggcaacggatttaattttatattcctctattaagtcctcgtcgataataacagaatgtagataatcatttaatccatcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagcgtagctcctacaggaatatctttaactaagtcaatgatttcatcaaccgttagatctattttaaagttaatcatataggcattgatttttaaaaggtatgtagccttgactacattttcattaattaaccattccaagtcactgtgtgtaagaagattatattctatcataagcttgactacatttggtcccaataccattaaagaattcttatgatataaggaaacagcttttaggtactcatctactctacaagaattttggagagccttaacgatatcagtgacgtttattatttcaggaggaaagaatctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattattttctcaacaagttctcaataccccaatagatgatagaatatcacccaatgcgtccatgttgtctatttccaacaggtcgctatatccaccaatagaagttttcccaaaaaagattctaggaacagttctaccaccagtaatttgttcaaaataatcccgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctgcaatatcttcgtaaaaagattcttgaaactttttagaatatctatcgactctagatgaaatagcgtgcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatcgatggcattaagaattcgtttttcgacatctgtcaaaaccaattcctttttgcctgtatcatccagttttccatcctttgtaaagaaattattttctactagactattaataagactgataaggattcctccataattgcacaatccaaactttttcacaaaactagactttacaagatctacaggaatgcgtacttcaggtttcttagcttgtgattttttcttttgtggacattttcttgtgaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaataccaaccccaacaaccggtattattagttgatgtggtagttttctcatcacttagaacagatttaacaatttctataaagtctgtcaaatcatctttcggagaacccatatatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagtgcgaatgtaatttttgtttccgttccggatctatagaaaactacaggtgtgataattgccttggccaattgtctttctcttttactgagtgattctagttcaccttctatagatctgagaatggatgattctccagtcgaaacatattctaccatggatccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcgcaaaccaccagtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaattatttaacttttcattaatagggatttgacgtatgtagcgtacaaaattatcgttcctggtatatagataaagagtcctatatatttgaaaatcgttacggctcgattaaactttaatgattgcatagtgaatatatcattaggatttaactccttgactatcatggcggcgccagaaattaccatcaaaagcattaatacagttatgccgatcgcagttagaacggttatagcatccaccatttatatctaaaaattagatcaaagaatatgtgacaaagtcctagttgtatactgagaattgacgaaacaatgtttcttacatatttttttcttattagtaaccgacttaatagtaggaactggaaaactagacttgattattctataagtatagatacccttccaaataatattctctttgataaaagttccagaaaatgtagaattttttaaaaagttatcttttgctattaccaagattgtgtttagacgcttattattaatatgagtgatgaaatccacaccgcctctagatatcgcttttatttccacattagatggtaaatccaatagtgaaactatctttttaggaatgtatggactcgcgtttagaggagtgaacgtcttgggcgtcggaaaggatgattcgtcaaacgaataaacaatttcacaaatggatgttaatgtattagtaggaaattttttgacgctagtggaattgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatccggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaatggagtaaaataaatatcattaatatatgctctaaatattagtatttttattaatcctttgattatcatcttctcgtacgcgaatgattccatgatcaagagtgatttgagaacatcctccggagtattaatgggcttagtaaacagtacatcgttgcaataataaaagttatccaagttaaaggatattatgcattcgtttaaagatatcacctcatctgacggagacaattttttggtaggttttagagactttgaagctacttgtttaacaaagttattcatcgtcgtttactattctatttaattttgtagttaatttatcacatatcacattaattgactttttggtccacttttccatacgtttatattcttttaatcctgcgttatccgtttccgttatatccagtgatagatcgtgcaggttaaatagaatgctcttaaataatgtcattttcttatccgctaaaaatttaaagaatgtataaacctttttcagagatttgaaactcttaggtggtgtcctagtacacaatatcataaacaaactaataaacattccacattcagattccaacagctgattaacttctacattaatacagcctattttcgctccaaatgtacattcgaaaaatctgaataaaacatcgatgtcacaatttgtattatccaatacagaatgtctgtgattcgtgttaaaaccatcggagaaggaatagaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaagaaatacgctaacggtatactagtaggtaactcaaagacatcatatatagaatggtaacgcgtctttaactcgtcggttaactctttcttttgatcgagttcgtcgctactattgggtctgctcaggtgccccgactctactagttccaacatcataccgataggaatacaagacactttgccggcggttgtagatttatcatatttttccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccacgaaacaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatatttttagcgtggatttctcatagacctgtagttttaactggaggaactggagtgggtaagacgtcacaggtacccaagttattgctttggtttaattatttatttggtggattctctactctagataaaatcactgactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgacagggaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggttttagatatagacgaaatattagaaaaagtgtattcatcacctaatgtatcgataattatttctactccttatttggaatccagcgttactatacacaatgttacacacatttatgatatgggtagagtttttgtccccgctccttttggaggatcgcaacaatttatttctaaatctatgagagatcaacgaaaaggaagagtaggaagagttaatcctggtacatacgtctatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataattttgagaggacgggagaattaactagtattgtacaagaagccattttatctctaaatttacgaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaattaaactctaatgaccacatctttttttagagatgaaaaattttccacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtacctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaatcagtccatcattggttgcgtcaagaactactatcggatgttgttgggtatctctagtgttacacatggccttactaaagtttgggtaaataactatgatatctctattaattatagatgcatatatttcatttgtcaaggatattagtatcgacttgctatcgtcattaatacgtgtaatgtaatcatataaatcatgcgatagccaaggaaaatttaaatagatgttcatcatataatcgtcgctataattcatattaatacgttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagatgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgttcaacttgtccaaattcctacttacagaagatgaggaatcgttggagatagtgtcttccttatgtagaggatttgaaatatcttatgatgacttgataacttactttccagataggaaataccataaatatatttataaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagggaagcaaatgatgacttgatagaatatctcctcaaggaatacactcctcagatttatacatattctaatgagcgagttcccatagctggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaacaggtggccaaactccataggtagctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcaaagtttcctattagggttccgcgctttacgtcacccagcatacttgaatcaccatcctttaaaaaaaatgataagatatcaacatggagtatatcatactcggattttaattcttctactgactcactgacattttcacaaatactacaatacggtttaccgaaaataatcaatacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgttagaattagaaaagtgtacatccgaaatacaaaatgttaccggatttatggaagaagaaataaaggcaaaaatgcaattaaaaatcgataaacttacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctgctgataatcatcctaagatgataaaaaacttaactcaactgtttaaatatgttccatctgcagaggataactatttagcaaaattaacggcgttagtgaatggatgtgatttctttcctggactctatggggcatctataacacccaacaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatgttcctccttgtcaatgcactgttcaagaatttatattttccgcattagatgaaaaatggaacaattttaaatcatcttatttagagaccgttccgttaccctgtcaattaatgtacgcgttagaaccacgtaaggagattgatgtttcagaagttaaaactttatcatcttatatagatttcgaaaatactaaatcagatatcgatgttataaaatctatatcctcgatttttggatattctaacgaaaactgtaacactatagtgttcggcatctataaggataatttactactgagtataaatagttcattttactttaacgatagtctgttaataaccaatactaaaagtgataatataataaatataggttactagattaaaaatggtgttccaactcgtgtgctctacatgcggtaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctaatacgtcattaactttattgggtattccgtatggatttggtcataatagaatgtattgttttaaattggtagctgaatgttataaaaatgccggtattgatacatcgtctaaacgaatattgggcaaagatatttttctgagccaaaacttcacagacgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttcttgctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtaaataccattaatcactgattcctttttcgatgccggacaatagcacaattgtttagctttggactctatgtattcagaattaatagatatatctcttaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtgtctataaatgtagactcgacggatgagttaatgtatatttttgccgccttgggcggatctgtaaacatttgggccattatacctctcagtgcatcagtgttctaccgcggagccgaaaatattgtgtttaatcttccggtgtccaaggtaaaatcgtgtttgtgtagttttcacaatgatgccatcatagatatagaacctgatctgaaaaataatctagtaaaactttctagttatcatgtagtaagtgtcgattgtaacaaggaactgatgcctattaggacagatactactatttgtctaagtatagatcaaaagaaatcttatgtgtttaattttcacaagtatgaagaaaaatgttgtggtagaaccgtcattcatctagaatggttgttgggctttatcaagtgtattagtcagcatcagcatctggctattatgtttaaagatgacaatattattatgaagactcctggtaatactgatgcattttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattttaggaatgttgttttcggatagagttcaatcctttaagatcaacatctttatggcgtttttagattaatactttcaatgagataaatatgggtggcggagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaaaaaggatggaaagatatcagataagtatgaagagggtgcagtattagaatcgtgttggccagacgttcacgacactggaaaatgcgatgttgatttattcgactggtgtcagggggatacgttcgatagaaacatatgccatcagtggatcggttcagcctttaataggagtgatagaactgtagagggtcaacaatcgttaataaatctgtataataagatgcaaacattatgtagtaaagatgctagtgtaccaatatgtgaatcatttttgcatcatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttgctaacacgtaattataataatttaggactttgcaatattgtacgatgtaataccagcgtgaacaacttacagatggataaaacttcctcattaagattgtcatgtggattaagcaatagtgatagattttctactgttcccgtcaatagagcaaaagtagttcaacataatattaaacattcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaacgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtgccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaagcgttgatgcaattgacgactaaggccactactcaaatagcacctagacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcgctgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggtggtgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctgtagcatactttttctttaccttgagaatatccatcgtttgcttggtcaatagcgatatgtgattttttatcaaccactcgaaaaagtaattggagtgttcatatcctctacgggctattgtctcatggccgtgtatgaaatttaagtaacacgactgtggtagatttgttctatagagccggttgccgcaaatagatagaactaccaatatgtctgtacaaatgttaaacattaattgattaacagaaaaaacaatgttcgttctgggaatagaaaccagattaaaacaaaattcgttagaatatatgccacgtttatacatggaatataaaataactacagtttgaaaaataacagtatcatttaaacatttaacttgcggggttaatttcacaactttactgtttttgaactgttcaaaatatagcatcgatccatgagaaatacgtttagccgcctttaatagaggaaatcccaccgcctttctggatctcaccaacgacgatagttctgaccagcaactcatttcttcatcatccacctgttttaacatataataggcaggagatagatatccgtcattgcaatattccttctcgtaggcacacaatctaatattgataaaatctccattctcttctctgcatttattatcttgtttcggtggctgattaggctgtagtcttggtttaggctttggtatatcgttgttgaatctattttggtcattaaatctttcatttcttcctggtatatttctatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgaaaatatcacaggagcaatgtttaccacaatgtataatataagaaacaatttgggtctaggcgatgataaactaactattgaagccattgaaaactatttcttggatcctaacaatgaggttatgcctcttatcattaataatacggatatgactgccgtcattcctaaaaaaagtggtaggagaaagaataagaacatggttattttccgtcaaggatcatcacctatcttgtgtattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccatgagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcgttgtattcattctaatatatgtattttttagatctgaattaaatatgttcttcatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagccgtgggtcattgttatgaatctctttcagaggaatacagacaattgacaaaattcacagactctcaagattttaaaaaactgtttaacaaggtccctattgttacagatggaagggtcaaacttaataaaggatatttgttcgactttgtgattagtttgatgcgattcaaaaaagaatcagctctagctaccaccgcaatagatcctgttagatacatagatcctcgtcgcgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgttgaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacatcgactcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatctgctcccggtacacatatacgttatttgagagatcatttctataatttaggagtgatcatcaaatggatgctaattgacggccgccatcatgatcctattttaaatggattgcgtgatgtgactctagtgactcggttcgttgatgaggaatatctacgatccatcaaaaaacaactgcatccttctaagattattttaatttctgatgtgagatccaaacgaggaggaaatgaacctagtacggcggatttactaagtaattacgctctacaaaatgtcatgattagtattttaaaccccgtggcatctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaagtatctagcaaagattttatgtctaaaaacagaaatagcaagagatccgtacgcagtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggtgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataatcaataatattatcttatatcttgtttagaaaaatgctaatattaaaatagctaacgctagtaatccaatcggaagccatttgatatctataatagggtatctaatttcctgattcagatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattatttttatagttgtaataaaaagggaaatttgattgtatactttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaagacttgtgggaaaacggaattggaatgtttcggtcactggggtaaagtaagtatttataaaactcatatagttaagcctgaatttatttcagaaattattcgtttactgaatcatatatgtattcactgcggattattgcgttcacgagaaccgtattccgacgatattaacctaaaagagttatcgggacacgctcttaggagattaaaggataaaatattatccaagaaaaagtcatgttggaacagtgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgttgattattagaccggctattagtttttggatagatagtatacccaaagaaaccaatgaattaacttacttattaggtatgatcgttaagaattgtaacttgaatgctgatgaacaggttatccagaaggcggtaatagaatacgatgatattaaaattatttctaataacactaccagtattaatttatcatatatcacatccggcaaaaataatatgattagaagttatatcgtcgcccggcgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcatcaaaccaagttaaattttactttaataaacgattaaaccaattaacaagaatacgccaaggaaagtttattaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgatttcgacggggatgaggaatggatgatattagaacaaaatcctaaagctgtaattgaacaaagtattcttatgtatccgacgacgttactcaaacacgatattcatggagcccctgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcccacagaactaatgtatattctaggtacttatggacaacagaggattgatggtgaaccagcagagactcgagtattgggtagagttttaccttactatcttccagactctaaggatccagaaggaagaggttatattcttaattctttaacaaaaggattaacaggttctcaatattacttttcgatgctggttgcaagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaaaaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccaaacatcactcttcgaaaagaaacagataaatatgtagtagatataatagttaatagattatacatcaagagagcagaaataaccgaattagttgtcgaatatatgattgaacgatttatctcctttagcgtcattgtaaaggaatggggtatggagacattcattgaggacgaggataatattagatttactgtctatctaaatttcgttgaaccagaggaattgaatcttagtaagtttatgatggttcttccgggggcagccaacaagggaaagattagtaaattcaagattcctatctctgactatacgggatatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcaatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttacccttgtcattatagtgggagatttggctctgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatattcgaattcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagcttagatttaacgttaaagatgagcataaacataataaacaaaattacaatcaaacctataacattaatatcaaacaatccaaaaaatgaaatcagtggagtagtaaacgcgtacataactcctggataacgtttagcagctgccgttcctattctagaccaaaaattcggtttcatgttttcgaagcggtgttctgcaacaagtcggggatcgtgttctacatatttggcggcgttatccagtatctgcctattgatcttcatttcgttttcgattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcgttgtcctttacatcatcgaacttctgatcattaatatgctcatgaacattaggaaatgtttctgatggaggtctatcaataactggcacaacaataacaggagttttcaccgccgccatttagttattgaaattaatcatatacaactctttaatacgagttatattttcgtctatccattgtttcacatttacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcaatttctatttttagatgtgatggaaaaatgactaattttgtagcattagtatcatgaactctaatcaaaatcttaatatcttcgtcacacgttagctctttgaagtttttaagagatgcatcagttggttctacagatggagtaggtgcaacaattttttgttctacacatgtatgtactggagccattgttttaactataatggtgcttgtatcgaaaaactttaatgcagatagcggaagctcttcgccgcgactttctacatcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatgtcatataggaaactataaagtccgcactactgttaagaatgattactaacgcaactatatagttcaaattaagcattttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaagaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtataataactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttagttggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgaaataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacaaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcggcgacattgtagaaagcgtggctgctgtagagctcgatgatagcgacggggatgatgaacctatggtacaagttgaagctggtaaagtaaatcatagtgctagaagcgatctttctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtattagatgataatccagcgtatgaggttttgcaacatgttaaaattcctactcatttaacagatgtagtagtatatgaacaaacgtgggaagaggcattaactagattaatttttgtgggaagcgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccgtcaccaaaaaagttaatagcattaactatcaaacaaactgctgaagttgtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtataaaatctctcgcaatgaccgctttctttggggagctaagcacattagatattatggcattgataatgtctatatttaaacgccatccaaacaataccattttttcagtggataaggatggtcagtttatgattgatttcgaatacgataattataaggcttctcaatatttggatctgaccctcactccgatatttggagatgaatgcaagactcacgcatcgagtatagccgaacaattggcgtgtgcggatattattaaagaggatattagcgaatacatcaaaactactccccgtcttaaacgatttataaaaaaataccgcaatagatcagatactcgtatcagtcgagatacagaaaagcttaaaatagctctagctaaaggcatagattacgaatatataaaagacgcttgttaataagtaaatgaaaaaaaactagtcgtttataataaaacacgatatggatgccaacgtagtatcatcttctactattgcaacgtatatagacgctttagcgaagaatgcttcagaattagaacagaggtctaccgcatacgaaataaataatgaattggaactagtatttattaagccgccattaattactttgacaaatgtagtgaatatctctacgattcaggaatcgtttattcgatttaccgttactaataaggaaggtgtcaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccaatctaaaagttctttgttgcacgctattaatcatccaaagtcaaggcctaatacatctctggaaatagaattcacacctagagacaatgaaacagttccatatgatgaactaataaaggaattgacgactctctcgcgtcatatatttatggcttctccagagaatgtaattctttctccgcctattaacgcgcctataaaaacctttatgttgcctaaacaagatatagtaggtttggatctggaaaatctatatgccgtaactaagactgacggcattcctataactatcagagttacatcaaacgggttgtattgttattttacacatcttggttatattattagatatcctgttaagagaataatagattccgaagtagtagtctttggtgaggcagttaaggataagaactggactgtatatctcattaagctaatagagcccgtgaatgctatcagtgatagactagaagaaagtaagtatgttgaatctaaactagtggatatttgtgatcggatagtattcaagtcaaagaaatacgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatatccccgttctaaatgcattaaataattccaatagagcgatttttgttcctataggaccttccaactgtggatactctgtattgttaatagatatattaatacttttgtcgggtaacagaggttctacgtcttctaaaaataaaagtttgataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtcgataacgacgataacgaagtatttatacttttaggaaatcacaatgactttatcagattaaaattaacaaaattaaaggagcatgtatttttttctgaatatattgtgactccagatacatatggatctttatgcgtcgaattaaatgggtctagttttcagcacggcggtagatatatagaggtggaggaatttatagatgctggaagacaagttagatggtgttctacatccaatcatatatctaaagatatacccgaagatatgcacactgataaatttgtcatttatgatatttatacgtttgattcgttcaagaataaacgattggtattcgtacaggtgcctccatcattaggagatgatagctatttgactaatccgttattgtctccgtattatcgtaattcagtagccagacaaatggtcaatgatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgcggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatctactgggataagatttccaagttactgctgcagcatataactaaacacgttagtgttctttattgtttgggtaaaacagatttctcgaatatacgggccaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcaactattagaggtaatgatgttatttttgtccttaagactataggtgtcccatcagcatgtagacaaaatgaagatccaagattcgtagaagcatttaaatgcgacgagttaaaaagatatattgagaataatccagaatgtacactattcgaaagtcttagggatgaggaagcatactctatagtcagaattttcatggatgtagatttagacgcgtgtctagacgaaatagattatttaacggctattcaagattttattatcgaggtgtcaaactgtgtagctagattcgcgtttacagaatgcggtgccattcatgaaaatgtaataaaatccatgagatctaatttttcattgactaagtctacaaatagagataaaacaagttttcatattatctttttagacacgtataccactatggatacattgatagctatgaaacgaacactattagaattaagtagatcatctgaaaatccactaacaagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacgacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccaagaaaacgaaagactgtagaagctaacatacgagacatgttagtagattcagtggagaccgatacctatccggataaacttccgtttaaaaatggtgtattggacctggtagacggaatgttttactctggagataatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagttgtacgaaaaaactttatctagttgtttatgcggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgacaatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatagatatagattcgcatttctatacttgttggtgaaatggtacagaaaatatcatgttcctattatgaaactatatcctacaccggaagagattccggactttgcattctatctcaaaataggtactctgttggtatctagctctgtaaagcatattccattaatgacggacctctccaaaaagggatatatattgtacgataatgtggtcactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgccgaacatcaacatcttaaaaattttcaattataatatgggtgtagctatgaacttgtttaatgacaaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttttactattgtctggatctcccattactaacacacctaatactctgggtcatattatagatttaatgtccgaagagacgatagattttggtgaaattattagtcgtggtaagaaagtaattcagacacttcttaacgaacgcggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttatcaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggcagtcaattgatgtttttgttttcgtcaaacattatgtccgaatcctatactctgaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtgacgtcattaaacgattacacacaggatgaattaattaatgttttaccatttgacatcaaaaagctgttatatctaaaatttaagacgaaagaaacgaatagaatatactctattcttcaagagatgtctgaaacgtattctcttccaccacatccatcaattgtaaaagttttattgggagaattggtcagacaatttttttataataattctcgtattaagtataacgactccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgagatatataaagaaataaatgtcgagctttgttaccaatggataccttccagttacattggaacctcatgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgtcgactcataaaaaagagaatagcggtaagtataaacacgaatactatggcaataattgcgaatgttttattcccttcgatatatttttgataatatgaaaaacatgtctctctcaaatcggacaaccatctcataaaatagttctcgcgcgctggagaggtagttgctgctcgtataatctccccagaataatatacttctgtgtcatcgttcaatttatacggatttctatagttctctgttatataatgcggtttgccctcatgattagacaacgacaatagtgttctgaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggcggatctaatggaatccaattgattaactatcttttgaaaatatacatttttatgatccaatacttgtaagaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatatgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcaaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtttagaaagaaacgattatttctgaattattccaattatttgtccaaacaggaaagaagtatactatcgtcatttttttctctatatccagctactgctgataatgatagaatagacgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctctaacgagtgatcaaatcattgatacatttaaaagtaatcatgaaatcaaggatctaatatttttagatccgaattcaggtaatggactacaatacgaaattgcaaaatatgctctagatactgcaaaacttaaatgttacggccatagaggatgttattacgaatcattaaaaaaattaactgaggatgattgattagaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatatacgaacatagtcctcctagtttggagactaattctttttcatcgactagacgtttattctcaaatagtgattggtgttgtaaggatcctggtcgtagtaagttaaccaacatggtgaattcttgcacactattgacgataggtgtagccgataaacaaatcatcttatggttttttaatgcgatggtcttggataaaaaattatatactgaacgagtaggacggatcttaccatcttctttgattaatgatttagaaatgaagttatgacattcatcaataatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccgacacccgtttcatggaacaataaaagagaatgcatactgtctaatcctaagaaaactcttgctacaaaatgttgataatccttgaggcgtactacgtctgttcccatcatttcaacaggcatattagtagttctgcgcaatgcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgcgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctagagacagattaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattagccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctcaacaatctcggcagactccggataaccagtcggtgggccatcactaacaataactagatcatccaacaatctactcacatatgcatctatataatctttttcatcttgtgagtaccctggatacgaaataaatttattatccgtatttccataataaggtttagtataaacagagagcgatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagaccgatacgtaattaatacatttatatccaacatatggtacgtaaccgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatataaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaagtttattgtatttataaccttttccttatcttcatagaatactaaaggcaacaaagaaatttttggttcttctctaagagctacgtgagacttaaccatagacgccaacgaatccctacatattttagaacagaaatacccaacttcaccacccttgaatgtctcaatactaataggtttaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacatactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacgtggaagtttgactttttttgtacctttgtacatttttgaaataccgactcgcaaaaaatacaatattcatatccttgttcagatactataccgttgtgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatatggttaccgtcctccgccaatatagtagttaaattatccgcacatgcagaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaactgcggactttaacctatacatgataccgtttagcatgatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatagcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgcgtggatgctacttcgtcgatggaaaccatacaatcctttttgataggctgttgagattgattatttcctgcacgtttaggtttggtacgttgatttctagcccctgcggatataaagtcatcgtctacaattttggataatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatatccaatcttattacttttggaatcgttcaaaacctttgactaattgtagaatttgatctattgccctacgcgtatactcccttgcatcatatacgttcgtcaccagatcgtttgtttcggcctgaagttggtgcatatctctttcaacattcgacatgagatccttaagggccatatcgtctagattttgttgagatgttgctcctggattttgttgtgctgttgtacatactgtaccaccagtaggtgtaggagtacatacagtggccacaataggaggttgaggaggtgtaaccgttggagtagtacaagaaatatttccatccgattgttgtgtacatgtagttgttggtaacgtctgagaaggttgggtagatggcggtgtcgtcgtcttttgatctttattaaatttagagataatatcctgaacagcattgctcggcgtcaacgctggaaggagtgaactcgccggcgcatcagtatctgcagacagccaatcaaaaagattagacatatcagatgatgtattagtttgttgtcgtggttttggtgtaggagcagtactactaggtagaagaataggagccgatgtaggtgtcggaaccggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatccttttcttcagaataatagattgacgactttggtgtagaggattctgccagcccctgtgagaacttgttaaagaagtccatttaaggctttaaaattgaattgcgattataagattaaatggcagacacagacgatattatcgactatgaatccgatgatctcactgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattctttcttgttatcagatatgaatttgataagactttgaacattattgatacccgtctgtttaattttttctacagatattttagttttggcagattctatcgtatctgtcaatagacatccaacatcgacattcgacgtcaattgtctataaatcaacgtataaattttagaaataacattagcgaattgttgtgcattgatgtcgttattctgaaacagtatgattttaggtagcattttcttaacaaagagaacgtatttattgttactcagttgaacagatgatatatccagattactaacgcatctgattccgtataccaaactttcagaagaaatggtgtacaattgtttgtattcattcaatgtctccttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacgatctccattatttttttggaatcggatacaatatcttcggtatcttgacgcaatctagtatacatagagttaagagaaattagagtttgtacattgagcaacatgtctctaaatgtggctacaaacttttcctttttcacatcatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcgtatagaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagtcgtttattatcttgttccatattagcagtcattccatcatttaagaaggcgtcaaagataatagggagaaatgacattttggattctgttacaactttaccaaaattaaggatatacggacttactatctttttttcaacgtcaatttgatgaacacacgatgaaaatgtacttcgatgagattgatcatgtagaaaacaacaagggatacaatatttccgcatatcatgaaatatattaagaaatcccaccttattatatttccccaaaggatccatgcacgtaaacattatgccgttatcattaataaagacttctttctcatcggatctgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcgtacgatccaaattccggaatagatgtatcgcacgctctagccacccagataaccaaaaagtcacacgctccaggatatacattgtataaaaagctatcgttttttagtagtgtttttttctgagtatatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggaaaatagcggttttatatcccgtagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcagaacttccaataaaattacttaaagatagaaatgaattatttacaaaattcatcaacgagttaaaaaagaccagttcattcaagataagcaaacgcgataaggatacgctactaaaatattttacttaggactggagttagaatttatagacgactcatttcgtttatcattgttactattattactattactatcattattagtgttggcattattagtattcttcttgtcatcttgttcagaaatatacagcaatgctatacctaatactaaatacattatcatgctcgcaatggctctaacaacgacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtaacaagatttttaaacaacaatgccattttacacgatgattgtctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatctccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttactcttggtctaatactgatgatagagatattattacttcccataatggatcttctagtagtcaccttaaagcccattgatgcaaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcccgtctcagaaagtcctatatgcatgatagatttatctttcctgggaaactctcgtatagtcatagatgaaatactcttcaaagtttctgaaataagattagtaacagtcttacctccgactactctaggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgtggtttctacctatgtctacaaattgcacgtttggaagcgtaactgttacgttcactgcagcattttgaggatttcgagtatgaagtacgatgttattgtttactggtatatctggaaagaattctaccagtctaggaataagagattgatatcgcatagaaatacaaaagttcataatctcatcatcgaagagcattttgttaccattgtaataaatatccactctgtcatatgtataaatgaagtactgttcaaacatgatgagatgtttatatgttggcatagtagtgagatcgacgtttggtaatggcaatgtattaagattaactccataatgtctagcagcatctgcgatgttataagcgtcgtcaaagcggggtcgatcttgtgctgttatatattgtctaacacctataagattatcaaaatcttgtctgcttaatacaccgttaacaatttttgccttgaattcttttattggtgcattaataacatccttatagaggatgttaaacaaataagtattatcaaagttaagatctgggtatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaataatagggttagtttccgaactaatgttaattggggtattaataatatctatatttccagcgttaagtgtaacattaaacagttttaattcacgtgacgtggtatcaattaaataattaatgcccaatttggatatagcagcctgaagctcatcttgtttagttacggatcctaatgagttattaagcaatatatcgaacggatgaacgaaggttgttttaagttggtcacatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacgtttcgtagagagttattgatatcggaacaacgtcaacaacgagaaaaaagatttaatattacagtatcgaaaaatgctgaagcaataatggaatctagatctatgataacttctatgccaacacaaacaccatccttgggagtagtttatgataaagataaaagaattcagatgttagaggatgaagtggttaatcttagaaatcaacgatctaatacaaaatcatctgataatttagataattttaccaaaatactatttggtaagactccgtacaaatcaacagaagttaataagcgtatagccatcgttaattatgcaaatttgaacgggtctcccttatcagtcgaggacttggatgtttgttcagaggatgaaatagatagaatctataaaacgattaaacaatatcacgaaagtagaaaacgaaaaattatcgtcactaacgtgattattattgtcataaacattatcgagcaggcattgctaaaactcggatttgaagaaatcaaaggactgagtaccgatatcacttcagaaattatcgatgtggagatcggagatgactgcgatgctgtagcatctaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtgggcatctttttagatggtttctttttcccagcattaactgattcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtttaggagcaccagaagtatttttggagcccttggatgttgatgtagaagaagacgaggattttgattttggtttacatgtaatacattttgaactctttgattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtatttcttggttctggaggaggcgaatttaaattcggacttggattcggattttgtgggttcttgatcttattatacagcgcatataggatggcgacggtaactgctacgcaaataccgatcaacaaaagaataccaatcatttattgacaataacttcactattgatcaagtatgcaatatatcatcttttcactaaataagtagtaataatgattcaacaatgtcgagatatatggacgataataacttagttcacggaaatatcgctatgattggtgtgaatgactccgctaactctgtggggcgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatgtccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgactctacctgatgaatcggacaatgtactgggccatgtagaataaattatcaacgaattatcgtctacgaacatttatatcatttgttttaattttaggacgcgaataaatggatataaaatagaaaataacagatattacaaccagtgttatggccgcgcccaaccaggtaggcagttttattttatcttttactacaggttctcctggatgatgtacgttaccaactgcagacgtagttctagtacaattagacgtaagttccgcttgggaattttttaacgctaaagagttaacgttaatcgtgcacccaacgtatttacatctagttctttgaacatcttgattataatataaccattttctatctctagattcgtcggtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcatcacaatgttctgtcttgtaattattattaaatatttttggacagtgtttggtatttgtcttagaacaacattttgccacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaatttgggtttaatttctcctggagacgtttcataataatacatataactttcttcggcaaacttaacagctctattatattcaggataattaaaacctaattccatatatttgtctcgtatatctgctattcctggtgctattttaattctattaagagtaacggctgcccccatttttaataatcgtcagtatttaaactgttaaatgttggtatatcaacatttaccttatttcccgcagtataaggtttgttgcaggtatactgttcaggaatggttacatttatacttcttctatagtcctgtctttcgatgttcatcacatatgcaaagaacagaataaacaaaataatgtaagaaataatattaaatatctgtgaattcgtaaatacattgattgccataataattacagcagctacaatacatacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggattttgtagaagttgaaccgggatcatcctttaagtttctgatacctaagggattttacgcctctccttccgtaaagacgagtctagtatttgaaacattaacaacgaccgataataaaatcactagtatcaatccaacaaatgcgccaaagttatatcctcttcaacgcaaagtcgtatctgaagtagtttctaatatgaggaaaatgatcgaatcaaaacgtcctctatacattactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaacagaatttattgtaacagtattattaatattgccaagttatccgatctaaaaaaaactatctatgcggtagatagtttttttgagccatattccacagacaatattagacatatggtaaaacgactagatggaccatctaataaatatcatatatataccgagaagttattatctgtagacgagcctagaaatcaacttattcttaataccctggtagaagaattcaagtcaggaactattaatcgcattttagttattactaaactacgtgaacatatggtattattctacaaacgattattagatcttttcggaccagaggttgtatttataggagacgcccaaaatagacgtactccagatatggtcaaatcaatcaaggaactaaatagatttatattcgtatccaccttattttattccggtactggtttagatattcctagtttggattctttgttcatttgctcggcagtaatcaacaatatgcaaatagagcaattactagggaggatatgtcgagaaacagaactattagataggacggtatatgtatttcctagcacatccatcaaagaaataaagtacatgataggaaatttcgttcaacgaattattagtctgtctgtagataaactaggatttaaacaaaaaagttatcggaaacatcaagaatccgatcccacttctgcatgtacaacatcatccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcgactcttcattccggaacgcacattggtgctatccatttaggtagtaaaaaataagtcagaatatgccctatagcacgatcgtgcaaaacctggtatatcgtctctatctttatcacaatatagtgtatcgacatttttattattattgacctcgtttatcttggaacatggaatggaaacatttttgttatcaacggccacctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgagattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagataatatgcgaagtgcgtgtaacaaagtattagatagtgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctcttttgatgataaatttccaaaaatatccatatcgtatattaagttgggagaacttaggcggcaagttgtagactttttcaaattctcattcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatggaaactttaaccagttcgtctcaatctttaatgtcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcatgccattaagaaactagtgtattgcgacatccaacttactaaacacattattaatcagaatacgtatccggtatttaacgattcttcacaagtgaaatgttgtcattatttcgatataaactcagataatagcaatattagctctcgtacagtagagatatttgagagggaaaagtcatctcttgtatcatatattaaaactaccaataagaagagaaaggtcaattatggggaaataaagaaaactgtacatggaggcactaatgcaaattacttttccggtaaaaagtctgatgagtatctgagcactacagtcaggtccaacattaatcaaccttggatcaaaaccatttctaagagaatgagagtagatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaagatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaacactgattcagaaatggatcaacgactagggtataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgattaacgagttcaaatatgaaatgctgcataactttttacctcatatgaactatacacccgatcaactaaagggattttatatgatatctttactaagaaagtttctctactgtatctaccacacttctagatatccagatagagattcgatggtttgtcatcgtatactaacatacggcaaatattttgagacgttggcacatgatgaattagagaattacataggcaacatccgaaacgatatcatgaacaatcacaagaacagaggcacttacgcggtaaacattcatgtactaacaactcctggacttaatcatgcgttttctagcttattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcggacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgatatgacattctctgacattcagaaagagtttccacatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtagcatcttcactagtgggaatcaatcacaattctggacccagagctattcttggatgtgctcaagctaaacaagctatctcttgtctgagttcggatatacgaaataaaatagacaatggaattcatttgatgtatccagagaggccaattgtcattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatatagttaccgcaaagaaacatcaagtagaaattccgttggaaaactttaataacaaagaaagagataggtctaacgcctattcaaaattagaaagtaatggattagttagactgaatgctttcttggaatccggagacgctatggcacgaaatatctcatcaagaactcttgaagatgattttgctagagataatcagattagcttcgatgtttccgagaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatgtcgcggatgaaacggaacttccatacgacgaaaatggtatcacaccagatgtcattattaattctacatccatcttctctagaaaaactatatctatgttgatagaagttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtctgatgaagaattatcggataaaatcttttgtgaaaagattctctatgatcctgaaacggataagccttatgcatccaaagtattttttggaccaatttattacttgcgtctgagacatttaactcaggacaaggcaaccgttagatgtagaggtaaaaagacgaagctcattagacaagcgaatgagggacgaaaacgtggaggaggtattaagtttggagaaatggagagagactgtttaatagcgcatggcgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagttaaattagatttcgaacgaaggcctccttcgttttataaaccattagataaagttgatctcaagccgtcttttctggtgtaatattctagtttggtagtagatacatatcaatatcatcaaattcgagatccgaattataaaatgggcgtggattgttaactatagaatcggacgtctgatattcgaaaatctgtggagtttcaggttttggtggaggtgtaactgctacttgggatactgaagtctgatattcagaaagctgggggatgttctggttcgacatccaccgatggtgtcacatcactaatcggttcggtaacgtctgtggatggaggtgctacttctacagaacctgtagcctcagttgtcaacggagatacatttttaatgcgaggaaatgtataatttggtaatggtttctcatgtggatctgaagaagaggtaagatatctactagaaagataccgatcacgttctagttctcttttgtagaacttaactttttctttctcagcatctagttgatattccaacctcttcacgttactacgttcagatttcaattcacgttcgcatgggttacctccgcagtttttacgagcgatttcacgttcagccttcatgcgtctttccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcgaaatatcgttccagctccttttcgacatcaataactttagcacgttgtctctcaagctctcttttgtagttatctgattccctggcacgtttaagatcttcatgcaattgagtcagctcttaacacaatctcttgcttcttcgtcatagtacttacaatcactatgggatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgccgaatagagttctgattcatcctttgagcagatctctagagatcgttcaagatccctgattctagtctttagcctatttacctcctcggaagatgctccgttaccgttgcgtttacactcgttaagctgtctatcaagatccatgattctatctctaagacgttgcatctctctttccatatcagcattgctttcattattacgtctgcagtcactcaactgtctttcaatatctgagattctatctctaagacgtcgcatctctctctgtttcggcattggtttcattattacgtctacagtcgttcaactgtctttcaagatctgatattctagattggagtctgctaatctctgtagcattttcacggcattcactcagttgtctttcaagatctgagattttagattggagtctgctaatctctgtaagatttcctcctccgctctcgatgcagtcggtcaacttattctctagttctctaatacgcgaacgcagtgcatcaacttcttgcgtgtcttcctggttgcgtgtacattcatcgagatctctaacgcgtcgtcgttcttcctcaagttctctgcgtactacagaaagcgtgtccctatcttgttgatatttagcaatttctgattctagagtactgattttgcttacgtagttactaatatttgtcttggccttatcaagatcctccttgtatttgtcgcattccttgatatccctacgaagtctggacagttcccattcgacattacgacgtttatcgatttcagctcggagatcgtcatcgcgttgttttagccacatacgactgagttcaagttctcgttgacaagatccatctacttttccattcctaatagtatccagttccttttctagttctgaacgcatttctcgttccctatcaagcgattctctcaattctcggatagtcttcttatcaatttctaataaatctgaaccatcatctgtcccattttgaatatccctgtgttctttgatctcttttgtaagtcggtcgattctttcggttttataaacagaatccctttccaaagtcctaatcttactgagtttatcactaagttctgcattcaattcggtgagttttctcttggcttcttccaactctgttttaaactctccactatttccgcattcttcctcgcatttatctaaccattcaattagtttattaataactagttggtaatcagcgattcctatagccgttcttgtaattgtgggaacataattaggatcttctaatggattgtatggcttgatagcatcatctttatcattattagggggatggacaaccttaattggttggtcctcatctcctccagtagcgtgtggttcttcaataccagtgttagtaataggcttaggcaaatgcttgtcgtacgcgggcacttcctcatccatcaagtatttataatcgggttctacttcagaatattcttttctaagagacgcgacttcgggagttagtagaagaactctgtttctgtatctatcaacgctggaatcaatactcaagttaaggatagcgaatacctcatcgtcatcatccgtatcttctgaaacaccatcatatgacatttcatgaagtctaacgtattgataaacagaatcagatttagtattaaacagatccttaacctttttagtaaacgcatatgtatattttagatctccagatttcataatatgatcacatgccttaaatgtcagtgcttccatgatataatctggaacactaatgggtgacgaaaaagatacagcaccatatgctacgttgataaataaatctgaaccactaagtagataatgattaatgttaaggaaaagaaaatattcagtgtataggtatgtcttggcgtcatatcttgtactaaacacgctaaacagtttattgatgtgatcaatttccaacagaataattagagcagcaggaataccaacaaacatattaccacatccgtattttctatgaatatcacatatcatgttaaaaaatcttgatagaagagcgaatatctcgtctgacttaatgagtcgtagttcagcagcaacataagtcataactgtaaatagaacatactttcctgtagtgttgattctagactccacatcaacaccattattaaaaatagttttatatacatctttaatctgctctccgttaatcgtcgaacgttctagtatacggaaacactttgatttcttatctgtagttaatgacttagtgatatcacgaagaatattacgaattacatttcttgtttttcttgagagacctgattcagaactcaactcatcgttccatagtttttctacctcagtggcgaaatctttggagtgcttggtacatttttcaataaggttcgtgacctccatttattataaaaaattttattcaaaacttaactacaatcgggtaattataaaatcgtagatctcccatgtggtggaatactaccatctatcgcatgtggatggacagtaggtaatggccatgggaacagtaatgtttgcatatttatctttcttgccagtattactgcatattgtcccaatgtttcgatgtgatgttctaacctatcaactgccgctgtatcacaacaatagtgtccgatgaaattaagattatgatccaatgtgtttaatatatgattatcaagtcttatacgatccgcgtcttttttgacaggatcaggttcttctacaggaagaagtttcggcctcttatgatattcatgtctgggaaacggtggtctagggtgaggctccggtatcggagtgggttttggattataatcatcatcgtctatgacatcatcttcgacttcgatatttattttgctatcttgatgatgtcctgtatcagttgcattttcagcactcgactgaatattagcgcattcattgtctattattaccatatttctaaatccaaaatgtatatgttgaacatcactactatcgttgatgagtcttatagcatgaattcgcttatcgttatcgggtttagcttctgtcaccttagcaattccttttttattaaactctacataatcatatccatttctattgtttgttctaatataaacgagtatagcatcattgctaaatttttcaatagtatcgaaaacagaatatcctaaaccatataatatatattcaggaacactcaaactaaatgtccaggattctcctaaatacgtaaactttaatagtgcgaaatcattcaaaaatctaccacttatagatagatagtacataaatgcgtatagtagtctacctatctctttattatgaaaaccggcattacgatcatatatatcatgatatacctgtgacccgtttacgttaaaccataaatacatgggtgatcctataaacatgaatttatttctaattctcagagctatagttaattgaccgtgtaatatttgcttacatgcatacttgatacgctcattaataagatttttatcattgctcgttatctcagaatcgtatatataaggagtaccatcgtgattcttaccagatattatacaaaatactatatataaaatatattgaccaacgttagtaatcatataaatgtttaacgttttaaattttgtattcaatgatccattatcatacgctagcatggtcttatgatattcattctttaaaatataatattgtgttagccattgcattggggctcctaatggagattttttattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatggacgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagcctttgtagaaaaaaattcagttgctggaattgcaagatcgtcatctccggggaaaagagttccgtccatttaaagtacagattttagaaactgacactctgcgttatttatatttggtacaacacatggattataaatatcgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtcgctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagagataactataaatggagatctagatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgggatcttttcaaatagactaaaaaccccatttctctagtaagtatcttatgtatatgtttgtaaaatatcttcatggtgggaatatgctctaccgcagttatccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtatcttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaatgatctaaagatgatgctattttacatggatttatcatatcatggagtgacaagtagtggagcaatttacaaattgggatcgtctatcgatagactttctctaaataggactattgttacaaaagttaataattatgatgatacattttttgacgacgatgattgatcgctattgcacaattttgtttttgtactttctaatatagtgtttaggttctttttcatatgagaatattgatttactaaaatatctatgtttaacttttgttctataacgtccttatcggcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgagatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagcttcctgactactaacgaaattaatatgatttggccaaatgtatccatcataatctgggttataaacgggtgtaaacaagaatatatgtttatattttttaactagtgtagaaaacagagatagtaaatagatagtttttccagatccagatcctcccgttaaaaccattctaaacggcatttttaataaattttctcttgaaaattgtttttcttggaaacaattcataattatatttacagttactaaattaatttgataataaatcaaaatatggaaaactaaggtcgttagtagggaggagaacaaagaaggcacatcgtgacataaataacatttattatcatgatgacaccagaaaacgacgaagagcagacatctgtgttctccgctactgtttacggagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacacaatatgatcacaaagaaagctgtaatggtttatattaccagggttcttgttatatattacattcagactaccagttattctcggatgctaaagcaaattgcactgcggaatcatcaacactacccaataaatccgatgtcttgattacctggctcattgattatgttgaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagccagattgcctagaccggatactagacatctgagagtattgtttagtattttttataaagattattgggtaagtttaaaaaagaccaataataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggattataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtaattaatgaaacggagactgttaaagtacttaatgaagataccaaacagaatcctaactattcatccaatcctttcgtaaattataataaaaccagtatttgtagcaagtcaaatccgtttattacagaacttaacaataaatttagtgagaataatccgtttagacgagcacatagcgatgattatcttaataagcaagaacaagatcatgaacacgatgatatagaatcatcggtcgtatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacgtcaatggcaaaaatattctaacctttcccattgatcatgctgtaatcatatccccactgagtaaatgtgtcgtagttagcaagggtcctacaaccatattggttgttaaagcggatatacccagcaaacgattggtaacatcgtttacaaacgacatactatatgtaaacaatctgtcactgattaattatttgccgttgtctgtattcattattagacgagttaccgactatttggatagacacatatgcgatcagatatttgcgaataataagtggtattccattataaccatcgacaataagcagtttcctattccatcaaactgtataggtatgtcctctgccaagtacataaattctagcatcgagcaagatactttaatacatgtttgtaacctcgagcatccattcgacttagtatacaaaaaaatgcagtcgtacaattctgtacctatcaaggaacaaatattgtacggtagaattgataatataaatatgagcattagtatttctgtgtattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgataaaaagaataagaataagatcaaggattatatggaacacgattattataaaataacaatagttcctggttcctcttccacgtctactagctcgtggtattatacacatgcctagtaatagtctctttgcgttgatggaaagcagactagaaataacaggctaaaatgttcagacaccataatagttcccaacccagataataacagagttccatcaacacattcctttaaactcaatcccaaacccaaaaccgttaaaatgtatccggccaattgatagtagataatgaggtgtacagcacatgataatttacacagtaaccaaaatgaaaacactttagtaattataagaaatatagacggtaatgtcatcatcaacaatccgataatatgcctgagagtaaacattgacggataaaacaaaaatgctccgcataactctatcatggcaataacacaaccaaatacttgtaagattcctaaattagtagaaaatacaacggatatcgatgtataagtgatctcgagaaataataagaataaagtaatgcccgtaaagataaacatcaacattgtttggtaatcattaaaccaattagtatgaagttgaactaatttcacagtagattttattccagtattatccccgcatgtatacgtacctggtaagatatctttatattctataatcaatgagacatcactatccgataacgaatgaagtctagcactagtatgccatttacttaatatggtcgtcttggaagttttattataagttaaaatatcatggttatccaatttccatctaatatactttgtcggattatctatagtacacggaataatgatggtatcattacatgctgtatactctatggtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatataacaacatctataaaagtagaggatgcggataaggatacattagtatgcggaaccaataacggaaatcccaaatgttggaaaatagacggttcagacgacccaaaacatagaggtagaggatacgctccttatagcaaagtaacgataatcagttacaacgaatgtgtactatctgacataaacatatcaaaagaaggaattaaacgatagagaagatttgacggaccatgtggttatgatttattcacggcggataacgtaattccaaaagatggtttacgaggagcattcgtcgataaagacggtacttatgacaaagtttacattcttttcactgatactatcggctcaaagagaattgttaaaattccgtatataacacaaatgtgcttaaacgacgaaggtggtccatcatcgttgtctagtcatagatggtcgacgtttctcaaagtcgaattagaatgtgacatcgacggaagaagttatagataaattattcattctaaaactataaaaacagataatgatacgatactatatgtattcttcgatagtccgcattatgtacctattctatgaataccattaaacaatctttttctacgtcaaaattggaaggatatacaaagcaattgccgtctccagctcctggtatatgtctaccagctggaaaagttgttccacataccacgtttgaagtcatagaaaaatataatgtactagatgatattataaagcctttatctaaccaacctatcttcgaaggaccgtctggcgttaaatggttcgatataaaggagaaggaaaatgaacatcgggaatatagaatatacttcataaaagaaaattctatatattcattcgatacaaaaactaaacaaactcgcagtgcacaagtcaatgcacaactattttcagtaatggtaactgcgaaaccgttatttatagcagatatagggataggagtaggaatgccacaaatgaaaaaaatacttaaaatgtaatcttaatcgagtacaccacacgacaatgaacaaacataagacagattatgctggttatgcttgctgcgtaatatgcggtctaattgttggaattatttttacagcgacactattaaaagttgtagaacgtaaattagttcatacaccatcaatagataaaacgataaaagatgcatatattagagaagattgtcctactgactggataagctataataataaatgtatccatttatctactgatcgaaaaacctgggaggaaggacgtaatacatgcaaagctctaaatccaaattcggatctaattaagatagagactccaaacgagttaagttttttaagaagcattagacgcggatattgggtaggagaatccgaaatattaaaccagacaaccccatataattttatagctaagaatgccacgaagaatggaaatatatttgtagtacaacgaatactcccaaactgcattcgtgttacactatataacaattacactacatttttatcataccactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccgcactcatcgtatattttgacgtatgcagtcacatcgtttacgcaatagtcagactgtagttctatcatgcttcctacatcagaaggaggaacagttttaaagtctcttggttttaatctattgccattagttttcatgaaatcctttgttttatccacttcacattttaaataaatgtccactatacattcttttgttaattttactagatcgtcatgggtcatagaatttataggttccgtagtccatggatccaaactagcaaacttcgcgtatacggtatcgcgattagtgtatacaccaactgtatgaaaattaagaaaacagtttaataaatcaacagaaatatttaatcctccgtttgatacagatgcaccatatttatggatttcggattcacacgttgtttgtctgaggtgttcgtctagtgttgcttctacataaacttcgattcccatatattctttattgtcagaatcgcataccgatttatcatcatacactgtttgaaaactaaatggtatacacatcaaaataataaataataacgagtacattctgcaatattgttatcgtaattggaaaaatagtgttcgagtgagttggattatgtgagtattggattgtatattttattttatattttgtaataagaatagaatgctaatgtcaagtttattccaatagatgtcttattaaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatccgggtgaaattattcctctcatcactaatcgtaatattctaaaacctcttattggtcagaaatattgtattgtatatactaactctctaatggacgagaacacgtatgctatggagttgcttactgggtacgcccctgtatctccgatcgttatagcgagaactcataccgcacttatatttttgatgggtaagccaacaacatccagacgtgacgtgtatagaacgtgtagagatcacgctacccgtgtacgtgcaactggtaattaaaataaaaagtaatattcatatgtagtgtcaattttaaatgatgatgatgaaatggataatatccatattgacgatgtcaataatgccggtattggcatacagctcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccaagtgtattattataataggatatgattctattatatggtataaagatataaatgacaagtataatggcatctatgattttactgcaatatgtatgctaatagcgtctacattgatagtgaccatatacgtgtttaaaaaaataaaaatgaacttttaattatgctatgctattagaaatggataaaatcaaaattacggttgattcaaaaattggtaatgttgttaccatattgtataacttggaaaagataactattgatgttacaccaaaaaagaaaaggatgtattattagcgcaatcagttgctgtcgaagaggcaaaagatgtcaaggtagaagaaaaaaatattatcgatattgaagatgacgatgatatggatgtagaaagcgcataatacgatctataaaaataagtatataaatactttttatttactgtactcttactgtgtagtggtgataccctactcgattatttttttaaaaaaaaaatacttattctgattcttctaaccatttccgtgttcgttcgaatgccacatcgacgtcaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaatcctagatccttgttctattcccaatggtttcatcaatagaagattaaacatatcgtacgaacacgatggagagtaatcgtagcaaaagtaagcatttcctttaatcttagatcccggatactggatatattttgcagccaacacgtgcatccatgcagcatttcctacatatacccggctatgtaccgcgttatcatcgactgtacgatacataatgttaccgtgttgcttacattgctcgtaaaagactttcgtcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaaaatagtctgtgttccataatagtttactttcatgatttcattatcggtgtattttccaaatacatccactagagcagctgtatgaataatcagatttaccccatttagcgcttctctcaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccacttataatatcaaactacttattctattttactaaataatggctgtttgtataataaaccacgataatatcagaggagttatttactttgaaccagttcatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatttacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgactccatagagataagaggggtgcttccagaggaaactaatattggttgcgcggttaatacgccggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaagtataggtgtatggcattagccgaacatatatctgatagtattccaatatctgagctatctagactacgatacaatctatgtaagtatctacgcgggcacactgagagcatagaggataaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaaaaaaattatactgtaacacaataaaggagtcttatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggagtattccaagagttttagttgtctagtatttaacaagagaagagatttcaacagactgtttatgaactcgaatgccgcctcattgtcgcttatattgatgatgtcgaattctcccaatatcatcaccgatgagtagctcatcttgttatcgggatccaagttttctaaagatgtcattaaaccctcgatcatgaatggatttatcatcatcgtttttatgttggacatgagcttagtccgtttgtccacatctatagaagatgatttctgaattatttcatatatctctctctttaactccaggaacttgtcaggatggtctactttaatatgttctcgtctaagagatgaaaatctttggatggttgcacgcgacttttctctaaaggatgacgttgcccaagatcctctcttaaatgaatccatcttatccttggacaagatggacagtctattttccttagatggtttaatatttttgttacccatgatctataaaggtagacctaatcgtctcggatgaccatatatttattttcagttttattatacgcataaattgtaaaaaatatgttaggtttacgaaaatgtctcgtggggcattaatcgtttttgaaggattggacaaatctggaaaaacaacacaatgtatgaacatcatggaatctataccggcaaacacgataaaatatcttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattctctggagtagcgtatgccgccgctaaaggcgcgtcaatgactctcagtaagagttatgaatctggattgcctaaacccgacttagttatattcttggaatctggtagcaaagaaattaatagaaacgtcggcgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatagatgttagtacagtgttataaatggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagatctatcagaccgaattgattaattcattagacgacaatgaaattatcgattgtatagttaataagtttatgagcttttataaggataacctagaaaatatagtagatgctatcattactctaaaatatataatgaataatccagattttaaaactacgtatgcagaagtactcggttccagaatagcggatatagatattaaacaagtgatacgtgagaatatactacaattgtctaataatatccgcgaacgatatttgtgaaaatattaaaaaaaaatactttttttattaaatgacgtcttttcgtgaatttagaaaattatgctgtgctatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattagtacattcttcaaagaaaacacagaaatccgtccaagagataaaagcattttaactttagaagacgtggatagtttcttaactacgttatcatccgtaactaaagaattgcatcaaataaaattattgactgatgtagcatctgtttgtacatgtaatgatttaaaatgtgtagtcatgcttattgataaagatctaaaaattaaagcgggccctcggtacgtacttaacgctattagtcctcatgcctatgatgtttttagaaaatctaataacttgaaagagataatagaaaatgcatctaaacaaaatctagactctatatctatttctgttatgactccaattaatcccatgttagcggaatcgtgtgattctgtcaataaggcgtttaaaaaatttccatcaggaatgtttgcggaagttaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggtatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcttactatggtaaaggagcaaagggtggtatcatggcagtctttctaatgggttgttacgacgataaatccggtaaatggaagacggttaccaagtgttcaggacacgatgataatacgttaagggagttgcaagaccaattaaagatgattaaaattaacaaggatcccaaaaaaattccagagtggttggtagttaataaaatctatattcccgattttgtagtagaggatccaaaacaatctcagatatgggaaatttcaggagcagagtttacatcttccaagtcacatacagcgaatggaatatcgattagatttcctagatttactaggataagagaggataaaacgtggaaagaatctactcatctaaacgatttagtaaacttgactaaatcttaatagttacatacaaactgaaaattaaaataacaccatttagttggtggtcgccatggatggtgttattgtatactgtctaaacgcgttagtaaaacatggcgaggaaataaatcatataaaaaatgatttcatgattaaaccatgttgtgaaaaagttaagaacgttcacatcgacggacaatctaaaaacaatacagtgattgcagatttgccatatctggataatgctgtatcggatgtatgcaaatcgatatatatatagtatcaagaatatccagatttgctaatttgataaagatagatgacgatgacaagactcctactggtgtatataattattttaaacctaaagatgccattcctgttattatatccataggaaaggatagagatgtttgtgaactattaatctcatctgataaagcgtgtgcgtgtatagagttaaattcatataaagtagccattcttcccatggatgtttccttttttaccaaaggaaatgcatcattgattattctcctgtttgatttctctatcgatgcggcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcgatagctgataatagaacttacgcaaatattagcaaaaatatattagacaatactacaattaacgatgagtgtagatgctgttattttgaaccacagattaggattcttgatagagatgagatgctcaatggatcatcgtgtgatatgaacagacattgtattatgatgaatttacctgatgtaggcaaatttggatctagtatgttggggaaatatgaacctgacatgattaagattgctcttttggtggctggtaatttaataagaaatcgagactacattcccgggagacgaggatatagctactacgtttacggtatagcctctagataatttttttaagcacgaaataaaaaacataattttaaaccaatctatttcatactattttgtgtgatcaccatggacataaagatagatattagtatttttggtgataaatttacggtgactactaggagggaaaatgaagaaaaaaaaaaatatctacctctccaaaaagaaaaaactactgatgttatcaaacctgattatcttgagtacgatgacttgttagatagagatgagatgtttactattctagaggaatattttatgtacagaggtctattaggcctcagaataaaatatggacgactctttaacgaaattaaaaaattcgacaatgatgcggaagaacaattcggtactatagaagaactcaagcagaaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagcgattaaactgtttattaatgatcacatgcttgataagataaaatctatactgcagaatagactagtgtatgtggaaatgtcatagaaagttaaaagttaatgagagcaaaaatatataaggttgtattccatatttgttattttttctgtaatagttaaaaaatacattcgatggtctatctatcagattattatgtgttataaggtactttttctcataataaactagagtatgagtaagatagtgtttttcaaaacatataaatctaaaattgatggatgagatatacagctattaatttcgaaaatatattttaatctgataactttaaacatggatttttgatggtggtttaaagtttaaaaaaaagattttgttattgtagtatatgataatatcaaaaagatggatataaagaatttgctgactgtatgtactattttttacattactacattggctacggcagatatacctacttcgtcactgccacacgctccggtaaacggggcatgtgacgagggagaatatcttgataagaggcataatcaatgttgtaatcagtgtccacctggagaatttgccaaggtcagatgtagtggtagtgataacacaaaatgtgaacgctgcccacctcatacatataccgcaatccccaattactctaatggatgtcatcaatgtagaaaatgcccaacaggatcatttgataaggtaaagtgtaccggaacacagaacagtaaatgttcgtgtcttcctggttggtattgcgctactgattcttcacagactgaagattgttgaaattgtgtaccaaaaaggagatgtccatgcggatactttggtggaatagatgaacaaggaaatcctatttgtaaatcgtgctgtattggtgaatattgcaactacctacgtaattatagacttgatccattttctccatgcaaactatctaaatgtaattaattatgattttgatgataatgttaccatacattatatcgctacttggttagtgtattattcagtatgaagacctattaataattacttatcttttgacgatcttgttataattataatataaaaacttatggcatagtaacttataattgctaacacgataaattcgtaataatctgttttgttcaaatttttataaggaatctacaggcataaaaataaaaatataatttataatatactcttacaacgccatcatgaatagcagcagtaaattaattgctgttattaatggatttagaaatagtggacgattttgtgatattaatatagttattaatgatgaaaggataaacgctcataaactcatcctatctggagcctccgaatatttttccattctgttttccaataattttatcgattctaatgaatacgaagttaatctaagtcatttagattatcaaagcgtaaacgatttgatcgattatatttatgggatacctttgagcctaactaacgataacgtgaaatatattctttcaaccgctgattttttacaaattggatctgctattacggagtgtgaaaattacatacttaaaaatctttgttctaaaaactgtatcgatttctacatatacgctgataaatataataacaagaaaatagaatcagcgtcgtttaacacaatattacaaaatattttgagactcatcaacgatgaaaactttaaatacttaacagaggaatcaatgataaaaattttaagcgatgatatgttaaatataaaaaatgaggatttcgccccactaattctcattaaatggttagagagtactcaacaatcatgcaccgtcgagttacttaaatgcctcagaatatcattgctttccccacaagttataaaatcactttatagtcatcaactggttagttcaatctacgaatgtataacattcttaaacaatatagcattcttggatgaatcatttcctagataccatagcatcgagttgatatctatcggtataagtaattcgcgtgataaaatttccataaactgctacaatcataaaaaaaatacatgggaaatgatatcttcacgtagatataggtgtagtttcgcagtggccgtcctggataatattatctatatgatgggtggatatgatcagtccccgtatagaagttcaaaggttatagcgtacaatacatgtacaaattcttggatatatgatataccagagctaaaatatcctcgttctaattgtgggggactggctgatgacgaatacatttattgtataggcggcatacgcgatcaggattcatcgttgacatctagtattgatagatggaagccatcaaaaccatattggcagaagtatgctaaaatgcgcgaaccaaaatgtgatatgggggttgcgatgttaaacggattaatatatgtcatgggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatctagtccttagctataattcgatatatgatgaatggaccaaattatcatcattaaatattcctagaattaatcccgctctatggtcagcgcataataaattatatgtaggaggaggaatatctgatgatgttcaaactaatacatctgaaacatacgataaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattctattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcaactacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatcgcgactccggaaccaattactgataatgtagaagatcatacagacaccgtcacatacactagtgatagcattaatacagtaagtgcaacatctggagaatccacaacagacgagactccggaaccaattactgataaagaagatcatacagttacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcatattgagcggaccatctggttcaggaaagacagccatagccaaaagactatgggaatatatttggatttgtggtgtcccataccactagatttcctcgtcctatggaacgagaaggtgtcgattaccattacgttaacagagaggccatctggaagggaatagccgccggaaactttctagaacatactgagtttttaggaaatatttacggaacttctaaaacagctgtgaatacagcggctattaataatcgtatttgtgtgatggatctaaacatcgatggcgttagaagtcttaaaaatacgtacctaatgccttactcggtgtatataagacctacctctcttaaaatggttgagaccaagcttcgttgtagaaacactgaagctaacgatgagattcatcgtcgcgtgatattggcaaaaacggatatggatgaggccaacgaagcaggtctattcgacactattattattgaagatgatgtgaatttagcatatagtaagttaattcagatactacaggaccgtattagaatgtattttaacactaattaaagacttaagacttaaaacttgataattaataatataactcgtttttatatgtgtctatttcaacgtctaatgtattagttaaatattaaaacttaccacgtaaaacttaaaatttaaaatggtatttcattgacagatagatcacacattatgaactttcaaggacttgtgttaactgacaattgcaaaaatcaatgggtcgttggaccattaataggaaaaggtggatttggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagattaccaaaaaggtcggtgatgttgatcggaatcgaaatcttaaataccatacaatttatgcacgagcaaggatattctcacggagatattaaagcgagtaatatagtcttagatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttgccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattacgacgagtttcggcacatattaatgcagggtgtatattattaagtgtggtgtttggtcgatgtaaaatttttgtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcaggaaatattctgttgtgtcagtttataataacaagtatgacattgtaaaagacaaatatatgtggtgttacagtcaggtgaacaagagatatattggagcactgctgcctatgtttgagtgcaatgaatatctacaaattggagatccgatccatgatcaagaaggaaatcaaatctctatcatcacatatcgccacaaaaactactatgctctaagcggaatcgggtacgagagtctagacttgtgtttggaaggagtagggattcatcatcacgtacttgaagcaggaaacgctgtatatggaaaagttcaacatgattattctactatcaaagagaaggccaaagaaatgagtacacttagtccaggacctataattgattaccacgtctggataggagattgtatctgtcaagttactgctgtggacgtacatggaaaggaaattatgaaaatgagattcaaaaagggtgcggtgcttccgatcccaaatctggtaaaagttaaacttggggagaatgatacagaaaatctttcttctactatatcggcggcaccatcgaggtaaccacctctctggaagacagcgtgaataatgtactcatgaaacgtttggaaactatacgccatatgtggtctgttgtatatgatcattttaatattgtgaatggtaaagaatgctgttatgtgcatacgcatttgtctaatcaaaatcttataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaatcaattgagagattggcagaggagttcttcaatagatcagaacttcaggctggtaaatcagttaaatttggtaattctattaattgttaaacatatacatctgtttcagctaagcaactaagaacacgtatacggcagcagcttccttctatactctcatcttttaccaagggtggatatttgttcattggagttgataataatacacacaaagtaattggattcacggtgggttacgactacctcagactggtagagaatgatatagaaaagcatatcaaaagactttgtgttgtgtatttctgtgagaagaaagaggacatcaagtacacgtgtcgattcatcaaggtatataaacctggggatgagactacctcgacatacgtgtgcgctatcaaagtggaaagatgctgttgtgctgtgtttgcagattggccagaatcatggtatatggatactaatggtatcaataagtattctccagatgaatgggtgtcacatataaaattttaattaatgtaatagagaacaaataataaggttgtaatatcatatagacaataactaacaattaattagtaactgttatctcttttttaactaaccaactaactatatacctattaatacatcgtaattatagttcttaacatctattaatcattaattcgcttctttaattttttataaactaacattgttaattgaaaagggataacatgttacagaatataaattatatatggatttttttaaaaaggaaatacttgactggagtatatatttatctcttcattatatagcacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcgggttatcatcatccattaatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgccgaagacagttacggttgtacattattacatagatgtatatatcactataagaaatcagaatcagaatcatacaatgaattaattaagatattgttaaataatggatccgatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacagaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaacataaacagcataatgcagatttattgaaaatgtgtataaaatatactgcgtgtatgaccgattatgatactcttatagatgtacagtcgctacagcaatataaatggtatattttaagatgtttcgatgaaatagatatcatgaagagatgttatataaaaaataaaactgtattccaattagttttttgtatcaaagacattaatactttaatgagatacggtaaacatccttctttcgtgaaatgcactagtctcgacgtatacggaagtcgtgtacgtaatatcatagcatctattagatatcgtcagagattaattagtctattatccaagaagctggatgcgggagataaatggtcgtgttttcctaacgaaataaaatataaaatattggaaaactttaacgataacgaactgtccacatatctaaaaatcttataaacattattaaaatataaaatctaagtaggataaaatcacactacatcattgtttccttttagtgctcgacagtgtatactatttttaacactcataaataaaaatgaaaacgatttccgttgttacgttgttatgcgtactacctgctgttgtttattcaacatgtactgtacccactatgaataacgctaaattaacgtctaccgaaacatcgtttaataataaccagaaagttacatttacatgtgatcagggatatcattctttggatccaaatgctgtctgcgaaacagataaatggaaatacgaaaatccatgcaagaaaatgtgcacagtttctgattatgtctctgaactatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatataactatcaactgtgatgttggatatgaggttattggtgcttcgtacataagttgtacagctaattcttggaatgttattccatcatgtcaacaaaaatgtgatataccgtctctatctaatggattaatttccggatctacattttctatcggtggcgttatacatcttagttgtaaaagtggttttatactaacgggatctccatcatccacatgtatcgacggtaaatggaatcccatactcccaacatgtgtacgatctaacgaaaaatttgatccagtggatgatggtcccgacgatgagacagatttgagcaaactctcgaaagacgttgtacaatatgaacaagaaatagaatcgttagaagcaacttatcatataatcatagtggcgttaacaattatgggcgtcatatttttaatctccgttatagtattagtttgttcctgtgacaaaaataatgaccaatataagttccataaattgctaccgtaaatataaatccgttaaaataattaataattaataacgaacaagtatcaaaagattaaagaattatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatattactgtatgtgtgggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcagtagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacatgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattaactgaatacgacgaccatatcaatttgtacatcgagcatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcggaagtatgtctgacacctaaaaagagtgtatatacatgcgcaattagatccaaagaagatgttcccaatttcaaggacaaaatggccagagttatcaagagaaaatttaataaacagtctcaatcttatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttttatcccgaaagaactgattgcagtgttcatctcccaactgcaagtgaaggattgataactgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcatcgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattgattgaaaatgaaaatataaatagtttttatgtatagcagtattaccctatagttttattgcttactactaacatggatacagatgttacaaatgtagaagatatcataaatgaaatagatagagagaaagaagaaatactaaaaaatgtagaaattgaaaataataaaaacattaacaagaatcatcccaatgaatatattagagaagcactcgttattaataccagtagtaatagtgattccattgataaagaagttatagaatgtatctgtcacgatgtaggaatatagatcatatctactaatttttataatcgatacaaaacataaaaaacaactcgttattacatagcaggcatggaatccttcaagtattgttttgataacgatggcaagaaatggattatcggaaatactttatattctggtaattcaatactatataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaaaaattcgggaagagtattcgccccaaaggatactgaatcagtcttcgaagcatgtgtcactatgataaacacgttagagtttatacactctcgaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaaaacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtaaactgtttatacaagattgaaattatattctttttttatagagtgtggtagtgttacggatatctaatattaatattagactatctctatcgcgctacacgaccaatatcgattactatggatatcttcagggaaatcgcatcttctatgaaaggagagaatgtatttatttctccagcgtcaatctcgtcagtattgacaatactgtattatggagctaatggatccactgctgaacagctatcaaaatatgtagaaacggaggagaacacggataaggttagcgctcagaatatctcattcaaatccatgaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaaccattgtctcctagcaattagtgccgtatactttaaagcaaaatggttgacgccattcgaaaaggaatttaccagtgattatcccttttacgtatctccgacggaaatggtagatgtaagtatgatgtctatgtacggcaaggcatttaatcacgcatctgtaaaggaatcattcggcaacttttcaatcatagaactgccatatgttggagatactagtatgatggtcattcttccagacaagattgatggattagaatccatagaacaaaatctaacagatacaaattttaagaaatggtgtgactttatggatgctatgtttatagatgttcacattcccaagtttaaggtaacaggctcgtataatctggtggatactctagtaaagtcaggactgacagaggtgttcggttcaactggagattatagcaatatgtgtaattcagatgtgagtgtcgacgctatgatccacaaaacgtatatagatgtcaatgaagagtatacagaagcagctgcagcaacttgtgcactggtgtcagactgtgcatcaacaattacaaatgagttctgtgtagatcatccgttcatctatgtgattaggcatgttgatggcaaaattcttttcgttggtagatattgctctccaacaactaattgttaaccattttttttaaaaaaatagaaaaaacatgtggtattagtgcaggtcgttattcttccaattgcaattggtaagatgacggccaactttagtacccacgtcttttcaccacagcactgtggatgtgacagactgaccagtattgatgacgtcaaacaatgtttgactgaatatatttattggtcgtcctatgcataccgcaacaggcaatgcgctggacagttgtattccacactcctctcttttagagatgatgcggaattagtgttcatcgacattcgcgagctggtaaaacatatgccgtgggatgatgtcaaagattgtgcagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctaaattacgtggattataacatcatattccggcgtatgaattgatgagttgtacatcttgacattttcttctttcttctcttctccctttcccagaaacaaactttttttacccactataaaataaaatgagtatactacctattatatttctttctatatttttttattcttcattcgttcagacttttaacgcgtctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagatcttatctcgtatccacaaatagtaaatgagagatctactggcgaaatggtatgtcccaatattaatgcatttattgctagtaacgtaaacgcagatattatatggagcggacatcgacgccttagaaataagagacttaaacaacggacacctggaattattaccatagaagatgttagaaaaaatgatgctggttattatacatgtgttttagaatatatatacggtggcaaaacatataacgtaaccagaattgtaaaattagaggtacgggataaaataataccttctactatgcaattaccagatggcattgtaacttcaataggtagtaatttgactattgcgtgtagagtatcgttgagacctcccacaacggacaccgacgtcttttggataagtaatggtatgtattacgaagaagatgatggggacggaaacggtagaataagtgtagcaaataaaatctatatgaccgataagagacgtgttattacatcccggttaaacattaatcctgttaaggaagaagatgctacaacgtttacgtgtatggcgtttactattcctagcatcagtaaaacagttactgttagtataacgtgaatgtatgttgttacatttccatgtcaattgagtttataagaatttttatacattatcttccaacaagcaattgacgaacgtattgctatgattaactcccacgatactatgcatattattaatcattaacttgcagactatacctagagctattttgacatactcgtgttcttgtgtaattgcagtatctatattattaaagtacgtaaatctagctatagttttattatttaattttagataatataccgtctccttatttttaaaaattgccacatcctttattaaatcatgaatgggaatttctatgtcatcgttagtatattgtgaacaacaagagcagatatctataggaaagggtggaatgcgatacattgatctatgtagttttaaaacacacgcgaactttgaagaatttatataaatcattccatcgatacatccttctatgttgacatgtatatatccaggaattcgtttattaatatcgggaaatgtataaactaaaacattgcccggaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtgcttgtatgtgttataaatataacgggatatagaactgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctgtcttcgatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcgaatcaactcataaaatacaagagaatgaaatatatacatattttagtcattgcaatatagaccatacttctacagaacttgattttgtagttaaaaactatgatctaaacagacgacaacctgtaactgggtatactgcactacactgctatttgtataataattactttacaaacgatgtactgaagatattattaaatcatggagtggatgtaacgatgaaaaccagtagcggacgtatgcctgtttatatattgcttactagatgttgtaatatttcacatgatgtagtgatagatatgatagacaaagataaaaaccacttatcgcatagagactattccaacctactactagagtatataaaatctcgttacatgttattgaaggaagaggatatcgatgagaacatagtatcaactttattagataagggaatcgatcctaactttaaacaagacggatatacagcgttacattattattatttgtgtctcgcacacgtttataaaccaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcaaaatatgtaataatcatggattaacgcctatactatgttatataacttccgactacatacaacacgatattcttgttatgttaatacatcactatgaaacaaatgttggagaaatgccgatagatgagcgtcgtataatcgtattcgagtttatcaaaacatattctacacgtccggcagattcgataacttatttgatgaataggtttaaaaatataaatatttatacccgctatgaaggaaagacattattacacgtagcatgtgaatataataatacacaagtaatagattatcttatacgtatcaacggagatataaatgcgttaaccgacaataacaaacacgctatccaactcattatagataacaaagaaaattccccgtataccatcgattgtttattgtatatacttagatatattgtagataagaatgtgataagatcgttggtggatcaacttccatctctacctatcttcaatataaaatcatttgagaaattcatatcctactgtatacttttagatgacacattttacaataggcacgttaggaatcgcaattctaaaacgtatcgatacgcattttcaaaatacatgtcgtttgataaatacgatggtataataactaaatgtcataaagaaacaatattgctcaaactatccactgttctagacactacactatatgcagttttaagatgccataattcgaaaaagttaagaagatacctcaacgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatatcgtatccacctaccaaagtatagttgtatttttctcatgcgatgtgtgtaaaaaaactgatattatataaatattttagtgccgtataataaagatgacgatgaaaatgatggtacatatatatttcgtatcattatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatggccactctaggagagccattcagcgcaaagtgtcctcctattgaagacagtcttttatcgcacagatataaagactatgtggttaaatgggaaaggctagaaaagaatagacggcgacaggtttctaataaacgtgttaaacatggtgatttatggatagccaactatacatctaaattcagtaaccgtaggtatttgtgtaccgtaactacaaagaatggtgactgtgttcagggtatagttagatctcatattagaaaacctccttcatgcattccaaaaacatatgaactaggtactcatgataagtatggcatagacttatactgtggaattctttacgcaaaacattataataatataacttggtataaagataataaggaaattaatatcgacgatattaagtattcacaaacgggaaagaaattaattattcataatccagagttagaagatagcggaagatacgactgttacgttcattacgacgacgttagaatcaagaatgatatcgtagtatcaagatgtaaaatacttacggttataccgtcacaagaccacaggtttaaactaaaaagaaattgcggatatgcgtcaaattaaaataaatggtacggacatgcttacagtgatgtacatgttaaataaacctacaaagaaacgatatgttaataatccgatatttacagattgggctaataagcaatataagttttataatcaaataatatataatgctaataagttaatagaacaaagtaagaaaatagacgacatgatagaggaggtatccattgacgataatcgtttatcaacactaccgttagaaattagacatttgattttctcgtacgcgttcctataaaaatagaaactataatcatataatagtgtaggttggtagtattgctcttgtgactagagactttagttaaggtactgtaaaaatagaaactataatcatataatagtgtaggttggtagtagggtactcgtgattaattttattgttaaacttgtccttaagtcttattaatatgtcttctaaagggggtagtggcggcatgtggagtgtctttatccatggacatgatggtagtaataaaggatctaaaacttatacatctggtggcggtggaatgtggggaggaggatcgtccagtggggttaacggaggtgtaaaatctggaactggtaaaatttaaacactaaattatttttattaataattgtacaagtttttgacatgatatttaatgacattagttgtgtgggtgtatagagttcacagtagctcattcagtcaaaatgtttgactatttggaaaatgaggaggtggctctcgatgaacttaaacagatgttgagagacagagatcctaatgataccaggaaccaattcaagaataatgctttacacgcatacctttttaatgagcattgtaataatgtcgaggtcgtcaaactactactagacagtggcactaatccattacgcaaaaattggagacagctaccccattagaagaatacacaaatagtagacatgttaaagttaaaggatatagcgatggctctactagaagccactggatttagcaacataaatgactttaatatattcagctatatgaaatccaaaaatgtagacgttgacttgataaaggtgttggtagaacatggatttgacttgagtgttaaatgtgaaaaccatcgttcagttatagaaaattatgtaatgacaatgatcctgttcctaaaattattgatttgttcatagaaaatggctgcagtgttctttatgaggacgagtactgatacgcgtatgatgattatcaactacgaaattgcggtaccgtattgcatctgtattcaaagtcggatacgagagcatatgtgcgtccggaagttgttaaatgtctaattaatcacggaatcaagccgtcttttatagataaaaactattgtacagctcttcaatattatattaagtcatctcatatagatatagacatcgttaaattgttaatgaaaggaatagataacactgcttattcatatatagacgatctaacatgttgcactcgaggaattatggctgattatctaaatagtgattatagatacaataaagatgtagatttggtcaaattgtttttggagaatggaaagcctcacggaataatgtgtagtattgtaccactatggagaaatgataaggaaaccatctttttgatattgaaaacaatgaactcggatgtcctccaacatatactaattgagtatatgacattcggcgatatccctctagtggaatatggaactgtggtaaataaagaggctatacacggatactttagaaatattaatattgattcttacacgatgaaatatctactaaaaaaggaagggagatgccatcaattatctcgatgatggagagatcccgattggacacctatgtaaatccaactatgaatgttataatttttacacttatacatacaaaaagggtctttgtgacatgtcttatgcttgcccaattcttagtactataaacatttgcctaccttatcttaaagacattaacatgattgacaaacgaggagaaacacttcttcacaaggctgttagatataataaacaatctctagtatctttactgctagaatccggttcagatgtcaacattagatcaaataacggatatacatgtatagccattgccatcaacgaatctaaaaacattgaactgctgaaaatgctattatgtcataaacctacattagattatgtgattgattcattgagagaaatatctaacatcgtagataactactatgctataaaacaatgtattaaatatgccatgattatagatgactgtacatcgtctaagattccagagtccataagtcaacgctataatgattatatagatctttgcaattaagaattgaatgagatgaaaaaaataatggtaggtggtaatactatgttctcattaatatttactgatcatggagctaaaattattcatagatatgccaataatccagaattacgtgagtattatgagttaaaacaaaataaaatatatgtggaagcatatgatattatttccaacgcaatagtgaaacatgatagaatacataaaaccatagaatcagttgatgataatacctacatttctaatcttccgtataccatcaaatacaaaatattcgagcaacaataagtattttttatacctttaaaattgataaataaattttttctagtgatattttggcaagatgagaatcctatttctcatcgccttcatgtatgggtgtgttcacccatatgttaatgccgacgaaatcaaatgtcctaacctaaacatcgtaacatcttctggagaatttcgttgcactggatgtgtgaaatttatgcctaattttagctacatgtattggttggcaaaggatatgagatcggacgaggataccaagtttatagaacatctgggtgatggcatcaaagaagatgaaaccgttcgtaccatagatggtagaatcgtcactctacagaaagtccttcatgtaaccgatactaataaatttgctcattataggttcacttgtgtcctcactacgatagatggcatttataaaaagaatgtttgctgaagtagttgtgtgctactatttttatttatgatataatctaaatgcaattgtcttgagaatccatccaatacggcagattatattagaaacaacgaattgaattgaatttaatctttcatacgagaaaaataacgacatacgtcgtcaacaaattaaactttttatttattagttaactagcttatagaacttgctcattgttatgtttctaaaacgggtacgacatataggacaattatccgacgcaccggtttctcttcgtgttttatgccatatattgatacatgttatgcaaaatatatgattacacgaatccaataaaccaaagtatctatcgttttgagtaaacaacttcatagcaaattccacattctttttctttacttactctatacacgtcctcgtatttatccagtattttgatgatatccaactcagaaatggttgttgtattattgggtgtataggtattattagctatgtaccaatttaccaaccttcttaatattgattgataatcacatcggttatccaattaataactaaattgtagtgtatatatagaccatatatgtttctatttttttgacagttacgtatagtttcagtaagttttgattgttgtattcctgtatctctagataagttagtcatatagtcccttccggcgatacgttttttccaggcccgaaattgattagccaaatgtggatttatttttgtgatattgatataatatttcggataatgcatactgttagtcttatatcatttggttcatctatgtattgtaatattgttacatgatctatagatgatgtattgattttggcaggatcgaattccatatccgcgactaaacagtgaaaaaaatgtaaatactttttaaattttaaattagtaaaacttttttttattttttatgattccaaaaatactgaatacaaagtcctaaattataaatatggagatcatactaccacaacttattattatgtatacaaggccggtgtaatagatagatatatataattctattacaccggcagacaattaccgatcggtatttgtcgttaccaacataccgtataatatgtaatatacaattccataacccattgacagttgttatacatcaaaattgcaattcttttgattacgatgttataagaatgtagttaattgatgtatgatgttaatgtgtcctctttcctcttataacatcgtaatcaaaaacttttttataatatatacctaataatgtgtcttaatagttctcgtgattcgtcaaacaatcattcttataaaatataataaatcaacgtaaaaacacataaaaataagcgtaactaataagacaatggatatttacgacgataaaggtctacagactattaaactgtttaataatgaatttgattgtataaggaatgacatcagagaattatttaaacatgtaactgattccgatagtatacaacttccgatggaagacaattctgatattatagaaaatatcagaaaaatactatatagacgattaaaaaatgtagaatgtgttgacatcgataacacaataacttttatgaaatacgatccaaatgatgataataagcgtacgtgttctaattgggtacccttaactaataactatatggaatattgtctagtaatatatttggaaacaccgatatgtggaggcaaaataaaattataccaccctacaggaaatataaagtcggataaggatattatgtttgcaaagactctagactttaaatcaaagaaagtgttaactggacgtaagacaattgccgttctagacatatccgtttcatataatagatcaataactactattcactacaacgacgacgttgatatagatatacatactgataaaaatggaaaagagttatgttattgttatataacaatagatgatcattacttggttgatgtggaaactataggagttatagtcaatagatctggaaaatgtctgttagtaaataaccatctaggtataggtatcgttaaagataaacgtataagcgatagttttggagatgtatgtatggatacaatatttgacttttctgaagcacgagagttattttcattaactaatgatgataacagaaatatagcatgggacactgataaactagacgatgatacagatatatggactcccgtcacagaagatgattacaaatttctttctagactagtattgtatgcaaaatctcaatcggatactgtattcgactattatgttcttactggtgatacggaaccacccactgtattcattttcaaggtaactagattttactttaatatgctgaaataaaaaatttttgtataatatctagaggtagaggtattgtttagataaatacaaataacatagatacatcgcatatttagcatttttataaatatacataagacatacactttatacatttttgtaaaaatactcataaaaaaaatttataaaaattatggcacaaccatatcttgtagaggtagtttagttcgtcgagtgaacctataaacagataatagacaacacataataataatgcctactaatacaagcataataccgggagatgggatatatgacgttgtagtgtttggtttttctgaacgttgatagtctactaatactacatgctgacatctaatgcctgtataaccatgagagcatctacaatacataccgtcgatatctctagcgtggatacagtcaccgtgtaaacaatatccatctccctctggaccgcataatctgatagctggaatatctgttgtagcgtttgtaatttctggcaatgtcgtttcgatagcgttaccactatcggcgaatgatctgattatcatagcagcgaacaacaacatcagatatttcatcgacatttttgatggattctgtgtttatgctgtttctcagtgtgtgtttatgacaagattgggaattttatattattaattcagtaatataaactaataatatattgttaattgtgtaaataatataaaaataacaatacaatattgaatgtgttgctgttaaaaatgtatgtgttaatataatagaataaaataaatgagtatgatcattttagataacgattgattttatcattacccttcattcttatattctttgcttacggaacctatatttagaaacatctactaacgattttttatgcttgcattattaatggtatgtaataccaatttgttaagtatgaatacggggtacaaacataaactgaaatttaacattatttatttatgatatatatcgttatcgttattgtttggtctataccatggatatctttaaagaactaatcgtaaaacaccctgatgaaaatgttttgatttctccagtttccattttatctactttatctattctaaatcatggagcagctggttctacagctgaacaactatcaaaatatatagagaatatgaatgagaatacacccgatgataagaaggatgacaataatgacatggacgtagatattccgtattgtgcgacactagctaccgcaaataaaatatacggtagcgatagtatcgagttccatgcctccttcctacaaaaaataaaagacgattttcaaactgtaaactttaataatgctaaccaaacaaaggaactaatcaacgaatgggttaagacaatgacaaatggtaaaattaattccttattgactagtccgctatccattaatactcgtatgacagttgttagcgccgtccattttaaagcaatgtggaaatatccattttctaaacatcttacatatacagacaagttttatatttctaagaatatagttaccagcgttgatatgatggtgggtaccgagaataacttgcaatatgtacatattaatgaattattcggaggattctctattatcgatattccatacgagggaaactctagtatggtgattatactaccggacgacatagaaggtatatataacatagaaaaaaatataacagatgaaaaatttaaaaaatggtgtggtatgttatctactaaaagtatagacttgtatatgccaaagtttaaagtggaaatgacagaaccgtataatctggtacctattctagaaaatttaggacttactaatatattcggatattatgcagattttagcaagatgtgtaatgaaactatcactgtagaaaaatttctacatacgacgtttatagatgttaatgaggagtatacagaagcatcggccgttacaggagtatttatgactaacttttcgatggtatatcgtacgaaggtctacataaaccatccattcatgtacatgattaaagacaacacaggacgtatactttttatagggaaatactgctatccgcaataaatataaacaaatagacttttatcacgtttatctatgtctaaatattacaaatagtataaactaaagctgataatacttaaaaaaataataatatcatttacaattaatagtataaactaaaaattaaacaaatcgttattataagtaatatcaaaatgatgatatacggattaatagcgtgtcttatattcgtgacttcatccatcgctagtccactttatattcccgttattccacccattacggaagataaatcgttcaatagtgtagaggtattagtttccttgtttagagatgaccaaaaagactatacggtaacttctcagttcaataactacactatcgataccaaagactggactatcggcgtactatccacacctgatggtttggatataccattgactaatataacttattggtcacggtttactataggtcgtgcattgttcaaatcagagtctgaggatattttccaaaagaaaatgagtattctaggtgtttctatagaatgtaagaagtcgtcgacattacttacttttttgaccgtgcgtaaaatgactcgagtatttaataaatttccagatatggcttattatcgaggagactgtttaaaagccgtttatgtaacaatgacttataaaaatactaaaactggagagactgattacacgtacctctctaatggggggttgcctgcatactatcgtaatggggtcgatggttgattattgattagtatattccttattcacacaaaaagaacatttttataaacatgaaaccactgtctaaatgtaattatgatcttgatttatagatgaagatcagcctttagaggattttaaccagtatgtttaatatgaaaaaaataaacataacatattttgagattaagcgctattgtgcttaattattttgctctataaactgaatatatagccacaattattgacgggcttgtttatgaccggcaatcatgaatttacagaaattatctctggctatatatcttactgcgacatgttcgtggtgttatgaaacatgcataagaaaaactgcgttgtatcatgacattcaattggagcatgtagaagacaataaagatagtgtagcgtcgctaccgtacaagtagtcaatcaaagagaacgtagtagattgttggctacatttaattggacagatatagctgagggtgttagaaatgagttcattaaaatatgtgatatcaacggaacatatttatataattatactattgctgttagtataattattgattccacggaagaactaccaacagttactccaattacaacaacatatgaaccttctacatataattatactatcgatgatagcactgttattactactgaagaactacaagtgactcctcatatggatctccatcgatgatacatgtattaaaatactttccgaataagtcttttaaatattgtattaattatgaaaaactatgctatgcgagtatgatgcaaagatgtttaatgatacgatactagattttatctctagcgagagatgtcgttagaatcatttatcataactacgtttaataataattcatcaacgaatatcgataacatgtgtcatttatacgtaaaagtctgtccgtcttctctatggtttagactgtttgtaaaatgctgtgatataaacaaactagtagaaggtacaactccgttacactgttatctaatgaatgaaggatttgaatcatctgttttaaaaaacctattaaaggagtatgtcatgacagtgatggtcacattccattacacaaatatttaactcatgatgaagttgagaatgatatgctttctgatagtatagatagctttagctaatataaaaatatattaatccactatatattctagacttgatttaaaaccgataaactactacgtactgtataagttgttaagaaaaggagcagaccctaattatgcagatgatagaggtaatacttttcttcattacttctgcatctatatgtccacttatgagaaaacgtcatttaataagatgcatcgtgaaaagaaatttattaaagagttggtaaaatatgaaaccgaaagtaaataatataggaaatacacctctacataactacgtatctcaatatgatatcactctcattcctcatccacaacccattaaaaaaatggaaattaaagccctctattagcataaacggctacaggtctacctttacaatggcctttccttgtgcccagttcagaccctgtcattgccacgctactaaggactccctgaataccgtggccgacgtcagacattgtctgactgaatacatcctgtgggtttctcatagatggacccatagagaaactgcagggcctctctacaggcttctcatctctttcagaactgatgcaacggagctctttggtggtgagttgaaggattcacttccgtgggacaatatcgacaattgcgtggagatcattaaatgtttcatcagaaatgactccatgaaaaccgccgaagaacttcgtgcaatcattggactttgtactcaatcagctatcgtctctggaagagtcttcaacgataagtatatcgacatactacttatgctgcgaaagattctgaacgagaacgactatctcaccctcttggatcatatccgcactgctaaatactaaatctccttcatgctctctcactacactttttatcatcttatgaggaatgattgccttcatcatttttcgtgaaataggaataattagcaccagaatagctatggattgcacatgtattctatgtcgtctactggatgaagatgtgacgtacaaaaaaataaaactagaaattgaaacgtgtcacaacttatcaaaacatatagatagacgaggaaacaatgcgctacattgttacgtcttcaataaatgcgatacagacattaagattgttcgactgttactctctcgcggagtcgagagactttgtagaaacaacgaaggattaactccgctaggagtatacagtaagcatagatacgtcaaatctcaaattgtgcatctactgatatccagctattcgaattcctctaacgaactcaagtcgaatataaatgatttcgatctgtattcggataatatcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacaacagtgatatgtgtaagaactctcttcattactatatatcgtctcatagagaatctcaatctctatccaaggatgtaattaaatgtttgatcaataacaatgtttccatccatggcagagacgaaggaggatctttacccatccaatactactggtctttctcaaccatagatatagagattgttaaattattattaataaaggatgtggacacgtgtagagtatacgacgtcagccctatattagaggcgtattatctaaacaagcgatttagagtaaccccatataatgtagacatggaaatcgttaatcttcttattgagagacgtcatactcttgtcgacgtaatgcgtagtattacttcgtacgattccagagaatataaccactacatcatcgataacattctaaagagatttagacaacaggatgaatccatcgtacaagccatgttgataaactacttacattacggcgatatggtcgttcgatgcatgttagataacggacaacaactatcctctgcacgactactttgttaataataatctcgtcgatgtaaacgtcgtaaggtttatcgtggaaaatatggacacgcggctgtaaatcacatatctaacaatggccgtctatgtatgtacggtctgatattatcgagatttaataattgcgggtatcactgttatgaaaccatactaatagatgtatttgatatactaagcaagtacatggataatatagatatgatcgataatgagaataaaactctactatattacgcggtcgatgtcaataatatacaatttgcaaagcggttattggaatatggagcgagtgttacaacatcacgctcgataatcaatacggccatccagaaaagtagttacagaagagaaaacaaaacgaagctagttgatttattacttagctaccatcccactctagagactatgattgacgcatttaatagagatatacgctatctatatcctgaaccattattcgcctgtatcagatacgccttaatcatagatgatgattttccttctaaagtaaagtatgatatcgccggtcgtcataaggaactaaagcgctatagagtagacattaatagaatgaagaatgcctacatatcaggcgtctccatgtttgatatattatttaaacgaagcaaacgccacagattgagatacgcaaagaatccgacatcaaatggtacaaaaaagaactaacgtccatcattacagaaactgtaaagaacaatgagaggatcgactccatagtggacaacattaatacagacgataacttgatttcgaaattacccatggagatactttattactccattaaataatttatcatggagcgataatgtcctgtttcatttgtttccatgacatattacaaaatcgattccgtccaagatgataaaaacatttaccggcatcataaacacggagtttattttatatgtctcgcataaacattactaaaaaaatatattgttcggttttctttcacatctttaattatgaaaaagtaaatcattatgagatggacgagattgtacgcatcgttcgcgacagtatgtggtacatacctaacgtatttatggacgacggtaagaatgaaggtcacgtttctgtcaacaatgtttgtcatatgtattttacgttctttgatgtggatacatcgtctcatctgtttaagctagttattaaacactgcgatctgaataaacgaggtaactctccattacattgctatacgatgaatacacgatttaatccatctgtattaaagatattgttacaccacggcatgcgtaactttgatagcaaggatgaccactatcaatcgataacaagatctttgatatactaacggacaccattgatgactttagtaaatcatccgatctattgctgtgttatcttagatataaattcaatgggagcttaaactattacgttctgtacaaaggatccgaccctaattgcgccgacgaggatgaactcacttctcttcattactactgtaaacacatatccacgttctacaaaagcaattattacaagtcaagtcacactaagatgcgagccgagaagcgattcatctacgcgataatagattatggagcaaacattaacgccgttacacacttaccttcaacagtataccaaacatagtcctcgtgtggtgtatgctcttttatctcgaggatacgtaataatcttgattgtacacccatcatggaacgattgtgcaacaggtcatattctcataatgttactcaattggcacgaacaaaaggaagaaggacaacatctactttatctattcataaaacataatcaaggatacactctcaatatactacggtatctactagataggttcgacattcagaaagacgaatattataataccgcctttcaaaattgtaacaacaatgttgcctcatacatcggatacgacatcaaccttccgactaaagacggtattcgacttggtgtttgaaaacagaaacatcatatacaaggcggatgttgtgaatgacatcatccaccacagactgaaagtacctatgattaaatcgttgttctacaagatgtcagaattctctccctacgacgattactacgtaaaaaagatactagcctactgcctattaagggacgagtcattcgcggaactacatagtaaattctgtttaaacgaggactataaaagtgtatttatgaaaaatatatcattcgataagatagattccatcatcgtgacataagtcgccttaaagagattcgaatctccgacaccgacctgtatacggtatcacagctatcttaaagccatacattcagacagtcacatttcatttcccatgtacgacgatctcatagaacagtgccatctatcgatggagcgtaaaagtaaactcgtcgacaaagcactcaataaattagagtctaccatcgatggccaatctagactatcgtatttgcctccggaaattatgcgcaatatcatctaaacagtatgttgtacggaaagaaccattacaaatattatccatgatagaaagaaaatatctatatgattggagaagtaggaaacaggaacaagacaacgattactacattattaaattatgaagtccgtattatactcgtatatattgtttctctcatgtataataataaacggaagagatatagcaccgcatgcaccatccgatggaaagtgtaaagacaacgaatacaaacgccataatttgtgtccgggaacatacgcttccagattatgcgatagcaagactaacacacaatgtacgccgtgtggttcgggtaccttcacatctcgcaataatcatttacccgcttgtctaagttgtaacggaagatgcgatcgtgtaacactactcacaatagaatctgtgaatgctctcccggatattattgtcttctcaaaggatcatccggatgcaaggcatgtgtttcccaaacaaaatgtggaataggatacggagtatccggagacgtcatctgttctccgtgtggtctcggaacatattctcacaccgtctcttccgcagataaatgcgaacccgtacccagaaatacgtttaactatatcgatgtggaaattaacctgtatccagttaacgacacatcgtgtactcggacgaccactaccggtctcagcgaatccatctcaacgtcggaactaactattactatgaatcataaagactgcgatcccgtctttcgtgatggatacttctctgtccttaataaggtagcaacttcaggtttctttacaggagaaaggtgtgcactctgaatttcgagattaaatgcaataacaaagattcttcctccaaacagttaacgaaagcaaagaatgatactatcatgccgcattcggagactgtctatctagcgtcgacatctatatactatatagtaataccaatactcaagactacgaaactgatacaatctcttatcatgtgggtaatgttctcgatgtcgatagccatatgcccggtagttgcgatatacataaactgatcactaattccaaacccacccgctttttatagtaagtttttcacccataaatacaataattaatttctcgtaaaagtagaaaatatattctaatttattgcacggtaaggaagtagaatcataaagaacagtaatcaatcaatagcaatcatgaaacaatatatcgtcctggcatgcatgtgcctgccagtcttcagcaatcctcctcctcgtgtacggaagaagaaaacaaacatcatatgggaatcgatgttattatcaaagtcacaaagcaagaccaaacaccgaccaatgataagatttgccaatccgtaacggaaattacagagtccgagtcagatccagatcccgaggtggaatcagaagatgattccacatcagtcgaggatgtagatcctcctaccacttattactccatcatcggtggaggtctgagaatgaactttggattcaccaaatgtcctcagattaaatccatctcagaatccgctgatggaaacacagtgaatgctagattgtccagcgtgtccccaggacaaggtaaggactctcccgcgatcactcatgaagaagctcttgctatgatcaaagactgtgaggtgtctatcgacatcagatgtagcgaagaagagaaagacagcgacatcaagacccatccagtactcgggtctaacatctctcataagaaagtgagttacgaagatatcatcggttcaacgatcgtcgatacaaaatgcgtcaagaatctagagtttagcgttcgtatcggagacatgtgcaaggaatcatctgaacttgaggtcaaggatggattcaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaatgttcttaactacattcacaaaaagttacctctcgcgacttcttctttttctgtctcaatagtgtgatacgattatgacactattcctattcctattcctatttcctttcagggtatcacaaaaatattaaacctctttctgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattttttttctctctttgagggtctcataaaaaaagttttacaaaaatatttttattctctttctctctttgatggtctcataaaaaatattaaacctctttctgatggtgtcactaaaatatttttattctcattctcattttctctttctctcttcaatggagtcataaaatatttttattctctttctctcttcgatggtctcacaaaaatattaaacctctttctgatggtgtcactaaaatatttttattctcattctcattttctctttctctcttcaatggagtcataaaatatttttattctctttctctcttcgatggtctcacaaaaatattaaacctctttctgatggagtcgtaaaaaagttttatctctttctctcttcgatggtctcactaaaatattttttattctctttctgatgcatcaactatttcttaaacaataacgtccaacaacatatactcgtcgagcttatcaacatcccctatgcccatctaggttaccagacaattgtatatcataaaataatgtttataatttacacgttaaaatcatataataaaacgtagatcgtataatattttttggtatataaatgatctagtaaaatccatgtaggggatactgctcacattttttctttggtacaaaatttcacacaagtttttatacagacaaattcttgtccatatattttaaaacattgacttttgtactaagaaaaatatctagactaactatctctttctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgagggtctcacaaaaatattaaacctctttctgatggagtcgtaaaaaagttttatctctttctccttcgatggtctcacaaaaatattaaacctctttttgatggagtcgtaaaaaagttttatctctttctccttcgatggtctcacaaaaatattaaacctctttctgatggtctctataaagcgatngatttttnttaatctgcatacatcataacctcctggnnnnnnnnagatagg

SEQ ID NO: 2 - DNA, 199234 bp, vaccinia virus
agagagaaagagaataaaaatatttttgtaaaactttatttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcagaaagaggtttaatatttttgtgataccctgaaaggaaataggaataggaataggaatagtgtcataatcgtatcacactattgagacagaaaaagaagaagtcgcgagaggtaactttttgtgaatgtagttaagaacatttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttgaatccatccttgacctcaagttcagatgattccttgcacatgtctccgatacgaacgctaaactctagattcttgacgcattttgtatcgacgatcgttgaaccgatgatatcttcgtaactcactttcttatgagagatgttagacccgagtactggatgggtcttgatgtcgctgtctttctcttcttcgctacatctgatgtcgatagacacctcacagtctttgatcatagcaagagcttcttcatgagtgatcgcgggagagtccttaccttgtcctggggacacgctggacaatctagcattcactgtgtttccatcagcggattctgagatggatttaatctgaggacatttggtgaatccaaagttcattctcagacctccaccgatgatggagtaataagtggtaggaggatctacatcctcgactgatgtggaatcatcttctgattccacctcgggatctggatctgactcggactctgtaatttccgttacggattggcaaatcttatcattggtcggtgtttggtcttgctttgtgactttgataataacatcgattcccatatgatgtttgttttcttcttccgtacacgaggaggaggattgctgaagactggcaggcacatgcatgccaggacgatatattgtttcatgattgctattgattgattactgttctttatgattctacttccttaccgtgcaataaattagaatatattttctacttttacgagaaattaattattgtatttatgggtgaaaaacttactataaaaagcgggtgggtttggaattagtgatcagtttatgtatatcgcaactaccgggcatatggctatcgacatcgagaacattacccacatgataagagattgtatcagtttcgtagtcttgagtattggtattactatatagtatatagatgtcgacgctagatagacagtctccgaatgcggcatgatagtatcattctttgctttcgttaactgtttggaggaagaatctttgttattgcatttaatctcgaaattcagagtgcacacctttctcctgtaaagaaacctgaagttgctaccttattaaggacagagaagtatccatcacgaaagacgggatcgcagtctttatgattcatagtaatagttagttccgacgttgagatggattcgctgagaccggtagtggtcgtccgagtacacgatgtgtcgttaactggatacaggttaatttccacatcgatatagttaaacgtatttctgggtacgggttcgcatttatctgcggaagagacggtgtgagaatatgttccgagaccacacggagaacagatgacgtctccggatactccgtatcctattccacattttgtttgggaaacacatgccttgcatccggatgatcctttgagaagacaataatatccgggagagcattcacagattctattgtgagtagtgttacacgatcgcatcttccgttacaacttagacaagcgggtaaatgattattgcgagatgtgaaggtacccgaaccacacggcgtacattgtgtgttagtcttgctatcgcataatctggaagcgtatgttcccggacacaaattatggcgtttgtattcgttgtctttacactttccatcggatggtgcatgcggtgctatatctcttccgtttattattatacatgagagaaacaatatatacgagtataatacggacttcataatttaataatgtagtaatcgttgtcttgttcctgtttcctacttctccaatcatatagatattttctttctatcatggataatatttgtaatggttctttccgtacaacatactgtttagatgatattgcgcataatttccggaggcaaatacgatagtctagattggccatcgatggtagactctaatttattgagtgctttgtcgacgagtttacttttacgctccatcgatagatggcactgttctatgagatcgtcgtacatgggaaatgaaatgtgactgtctgaatgtatggctttaagatagctgtgataccgtatacaggtcggtgtcggagattcgaatctctttaaggcgacttatgtcacgatgatggaatctatcttatcgaatgatatatttttcataaatacacttttatagtcctcgtttaaacagaatttactatgtagttccgcgaatgactcgtcccttaataggcagtaggctagtatcttttttacgtagtaatcgtcgtagggagagaattctgacatcttgtagaacaacgatttaatcataggtactttcagtctgtggtggatgatgtcattcacaacatccgccttgtatatgatgtttctgttttcaaacaccaagtcgaataccgtctttagtcggaaggttgatgtcgtatccgatgtatgaggcaacattgttgttacaattttgaaaggcggtattataatattcgtctttctgaatgtcgaacctatctagtagataccgtagtatattgagagtgtatccttgattatgttttatgaatagataaagtagatgttgtccttcttccttttgttcgtgccaattgagtaacattatgagaatatgacctgttgcacaatcgttccatgatgggtgtacaatcaagattattacgtatcctcgagataaaagagcatacaccacacgaggactatgtttggtatactgttgaaggtaagtgtgtaacggcgttaatgtttgctccataatctattatcgcgtagatgaatcgcttctcggctcgcatcttagtgtgacttgacttgtaataattgcttttgtagaacgtggatatgtgtttacagtagtaatgaagagaagtgagttcatcctcgtcggcgcaattagggtcggatcctttgtacagaacgtaatagtttaagctcccattgaatttatatctaagataacacagcaatagatcggatgatttactaaagtcatcaatggtgtccgttagtatatcaaagatcttgttatcgattgatagtggtcatccttgctatcaaagttacgcatgccgtggtgtaacaatatctttaatacagatggattaaatcgtgtattcatcgtatagcaatgtaatggagagttacctcgtttattcagatcgcagtgtttaataactagcttaaacagatgagacgatgtatccacatcaaagaacgtaaaatacatatgacaaacattgttgacagaaacgtgaccttcattcttaccgtcgtccataaatacgttaggtatgtaccacatactgtcgcgaacgatgcgtacaatctcgtccatctcataatgatttactttttcataattaaagatgtgaaagaaaaccgaacaatatatttttttagtaatgtttatgcgagacatataaaataaactccgtgtttatgatgccggtaaatgtttttatcatcttggacggaatcgattttgtaatatgtcatggaaacaaatgaaacaggacattatcgctccatgataaattatttaatggagtaataaagtatctccatgggtaatttcgaaatcaagttatcgtctgtattaatgttgtccactatggagtcgatcctctcattgttctttacagtttctgtaatgatggacgttagttcttttttgtaccatttgatgtcggattctttgcgtatctcaatctgtggcgtttgcttcgtttaaataatatatcaaacatggagacgcctgatatgtaggcattcttcattctattaatgtctactctatagcgctttagttccttatgacgaccggcgatatcatactttactttagaaggaaaatcatcatctatgattaaggcgtatctgatacaggcgaataatggttcaggatatagatagcgtatatctctattaaatgcgtcaatcatagtctctagagtgggatggtagctaagtaataaatcaactagcttcgttttgttttctcttctgtaactacttttctggatggccgtattgattatcgagcgtgatgttgtaacactcgctccatattccaataaccgctttgcaaattgtatattattgacatcgaccgcgtaatatagtagagttttattctcattatcgatcatatctatattatccatgtacttgcttagtatatcaaatacatctattagtatggtttcataacagtgatacccgcaattattaaatctcgataatatcagaccgtacatacatagacggccattgttagatatgtgatttacagccgcgtgtccatattttccacgataaaccttacgacgtttacatcgacgagattattattaacaaagtagtcgtgcagaggatagttgttgtccgttatctaacatgcatcgaacgaccatatcgccgtaatgtaagtagtttatcaacatggcttgtacgatggattcatcctgttgtctaaatctctttagaatgttatcgatgatgtagtggttatattctctggaatcgtacgaagtaatactacgcattacgtcgacaagagtatgacgtctctcaataagaagattaacgatttccatgtctacattatatggggttactctaaatcgcttgtttagataatacgcctctaatatagggctgacgtcgtatactctacacgtgtccacatcctttattaataataatttaacaatctctatatctatggttgagaaagaccagtagtattggatgggtaaagatcctccttcgtctctgccatggatggaaacattgttattgatcaaacatttaattacatccttggatagagattgagattctctatgagacgatatatagtaatgaagagagttcttacacatatcactgttgtacatacaggtacgaaatacgtaaccggtgctgtaacattctgatttaagaagccatagcaatacttctggtctcggattaggcgtcgttacgtatatatccaccaatccgagaccattgattgcataattcgtattcttggacggacgtatccgtttatccacaattaggtattttagcagacgtaagtcgatattatccgaatacagatcgaaatcatttatattcgacttgagttcgttagaggaattcgaatagctggatatcagtagatgcacaatttgagatttgacgtatctatgcttactgtatactcctagcggagttaatccttcgttgtttctacaaagtctctcgactccgcgagagagtaacagtcgaacaatcttaatgtctgtatcgcatttattgaagacgtaacaatgtagcgcattgtttcctcgtctatctatatgttttgataagttgtgacacgtttcaatttctagttttatttttttgtacgtcacatcttcatccagtagacgacatagaatacatgtgcaatccatagctattctggtgctaattattcctatttcacgaaaaatgatgaaggcaatcattcctcataagatgataaaaagtgtagtgagagagcatgaaggagatttagtatttagcagtgcggatatgatccaagagggtgagatagtcgttctcgttcagaatctttcgcagcataagtagtatgtcgatatacttatcgttgaagactcttccagagacgatagctgattgagtacaaagtccaatgattgcacgaagttcttcggcggttttcatggagtcatttctgatgaaacatttaatgatctccacgcaattgtcgatattgtcccacggaagtgaatccttcaactcaccaccaaagagctccgttgcatcagttctgaaagagatgagaagcctgtagagaggccctgcagtttctctatgggtccatctatgagaaacccacaggatgtattcagtcagacaatgtctgacgtcggccacggtattcagggagtccttagtagcgtggcaatgacagggtctgaactgggcacaaggaaaggccattgtaaaggtagacctgtagccgtttatgctaatagagggctttaatttccatttttttaatgggttgtggatgaggaatgagagtgatatcatattgagatacgtagttatgtagaggtgtatttcctatattatttactttcggtttcatattttaccaactctttaataaatttcttttcacgatgcatcttattaaatgacgttttctcataagtggacatatagatgcagaagtaatgaagaaaagtattacctctatcatctgcataattagggtctgctccttttcttaacaacttatacagtacgtagtagtttatcggttttaaatcaagtctagaatatatagtggattaatatatttttatattagctaaagctatctatactatcagaaagcatatcattctcaacttcatcatgagttaaatatttgtgtaatggaatgtgaccatcactgtcatgacatactcctttaataggttttttaaaacagatgattcaaatccttcattcattagataacagtgtaacggagtcgtaccttctactagtttgtttatatcacagcattctacaaacagtctaaacaatagagaagacggacagactttaacgtataaatgacacatgttatcgatattcgttgatgaattattattaaacgtagttatgataaatgattctaacgacatctctcgctagagataaaatctagtatcgtatcattaaacatctttgcatcatactcgcatagcatagtttttcataattaatacaatatttaaaagacttattcggaaagtattttaatacatgtatcatcgatggagatccatatgaggagtcacttgtagttcttcagtagtaataacagtgctatcatcgatagtataattatatgtagaaggttcatatgttgttgtaattggagtaactgttggtagttcttccgtggaatcaataattatactaacagcaatagtataattatataaatatgttccgttgatatcacatattttaatgaactcatttctaacaccctcagctatatctgtccaattaaatgtagccaacaatctactacgttctctttgattgactacttgtacggtagcgacgctacactatctttattgtcttctacatgctccaattgaatgtcatgatacaacgcagtttttcttatgcatgtttcataacaccacgaacatgtcgcagtaagatatatagccagagataatttctgtaaattcatgattgccggtcataaacaagcccgtcaataattgtggctatatattcagtttatagagcaaaataattaagcacaatagcgcttaatctcaaaatatgttatgtttatttttttcatattaaacatactggttaaaatcctctaaaggctgatcttcatctataaatcaagatcataattacatttagacagtggtttcatgtttataaaaatgttctttttgtgtgaataaggaatatactaatcaataatcaaccatcgaccccattacgatagtatgcaggcaaccccccattagagaggtacgtgtaatcagtctctccagttttagtatttttataagtcattgttacataaacggcttttaaacagtctcctcgataataagccatatctggaaatttattaaatactcgagtcattttacgcacggtcaaaaaagtaagtaatgtcgacgacttcttacattctatagaaacacctagaatactcattttcttttggaaaatatcctcagactctgatttgaacaatgcacgacctatagtaaaccgtgaccaataagttatattagtcaatggtatatccaaaccatcaggtgtggatagtacgccgatagtccagtctttggtatcgatagtgtagttattgaactgagaagttaccgtatagtctttttggtcatctctaaacaaggaaactaatacctctacactattgaacgatttatcttccgtaatgggtggaataacgggaatataaagtggactagcgatggatgaagtcacgaatataagacacgctattaatccgtatatcatcattttgatattacttataataacgatttgtttaatttttagtttatactattaattgtaaatgatattattatttttttaagtattatcagctttagtttatactatttgtaatatttagacatagataaacgtgataaaagtctatttgtttatatttattgcggatagcagtatttccctataaaaagtatacgtcctgtgttgtctttaatcatgtacatgaatggatggtttatgtagaccttcgtacgatataccatcgaaaagttagtcataaatactcctgtaacggccgatgcttctgtatactcctcattaacatctataaacgtcgtatgtagaaatttttctacagtgatagtttcattacacatcttgctaaaatctgcataatatccgaatatattagtaagtcctaaattttctagaataggtaccagattatacggttctgtcatttccactttaaactttggcatatacaagtctatacttttagtagataacataccacaccattttttaaatttttcatctgttatatttttttctatgttatatataccttctatgtcgtccggtagtataatcaccatactagagtttccctcgtatggaatatcgataatagagaatcctccgaataattcattaatatgtacatattgcaagttattctcggtacccaccatcatatcaacgctggtaactatattcttagaaatataaaacttgtctgtatatgtaagatgtttagaaaatggatatttccacattgctttaaaatggacggcgctaacaactgtcatacgagtattaatggatagcggactagtcaataaggaattaattttaccatttgtcattgtcttaacccattcgttgattagttcctttgtttggttagcattattaaagtttacagtttgaaaatcgtcttttattttttgtaggaaggaggcatggaactcgatactatcgctaccgtatattttatttgcggtagctagtgtcgcacaatacggaatatctacgtccatgtcattattgtcatccttcttatcatcgggtgtattctcattcatattctctatatattttgatagttgttcagctgtagaaccagctgctccatgatttagaatagataaagtagataaaatggaaactggagaaatcaaaacattttcatcagggtgttttacgattagttctttaaagatatccatggtatagaccaaacaataacgataacgatatatatcataaataaataatgttaaatttcagtttatgtttgtaccccgtattcatacttaacaaattggtattacataccattaataatgcaagcataaaaaatcgttagtagatgtttctaaatataggttccgtaagcaaagaatataagaatgaagggtaatgataaaatcaatcgttatctaaaatgatcatactcatttattttattctattatattaacacatacatttttaacagcaacacattcaatattgtattgttatttttatattatttacacaattaacaatatattattagtttatattactgaattaataatataaaattcccaatcttgtcataaacacacactgagaaacagcataaacacagaatccatcaaaaatgtcgatgaaatatctgatgttgttgttcgctgctatgataatcagatcattcgccgatagtggtaacgctatcgaaacgacattgccagaaattacaaacgctacaacagatattccagctatcagattatgcggtccagagggagatggatattgtttacacggtgactgtatccacgctagagatatcgacggtatgtattgtagatgctctcatggttatacaggcattagatgtcagcatgtagtattagtagactatcaacgttcagaaaaaccaaacactacaacgtcatatatcccatctcccggtattatgcttgtattagtaggcattattattatgtgttgtctattatctgtttataggttcactcgacgaactaaactacctctacaagatatggttgtgccataatttttataaattttttttatgagtatttttacaaaaatgtataaagtgtatgtcttatgtatatttataaaaatgctaaatatgcgatgtatctatgttatttgtatttatctaaacaatacctctacctctagatattatacaaaaattttttatttcagcatattaaagtaaaatctagttaccttgaaaatgaatacagtgggtggttccgtatcaccagtaagaacataatagtcgaatacagtatccgattgagattttgcatacaatactagtctagaaagaaatttgtaatcatcttctgtgacgggagtccatatatctgtatcatcgtctagtttatcagtgtcccatgctatatttctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccatttttatcagtatgtatatctatatcaacgtcgtcgttgtagtgaatagtagttattgatctattatatgaaacggatatgtctagaacggcaattgtcttacgtccagttaacactttctttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtgttatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgtttttacgttgatttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccgatcggtaattgtctgccggtgtaatagaattatatatatctatctattacaccggccttgtatacataataataagttgtggtagtatgatctccatatttataatttaggactttgtattcagtatttttggaatcataaaaaataaaaaaaagttttactaatttaaaatttaaaaagtatttacatttttttcactgtttagtcgcggatatggaattcgatcctgccaaaatcaatacatcatctatagatcatgtaacaatattacaatacatagatgaaccaaatgatataagactaacagtatgcattatccgaaatattatatcaatatcacaaaaataaatccacatttggctaatcaatttcgggcttggaaaaaacgtatcgccggaagggactatatgactaacttatctagagatacaggaatacaacaatcaaaacttactgaaactatacgtaactgtcaaaaaaatagaaacatatatggtctatatatacactacaatttagttattaattggataaccgatgtgattatcaatcaatattaagaaggttggtaaattggtacatagctaataatacctatacacccaataatacaacaaccatttctgagttggatatcatcaaaatactggataaatacgaggacgtgtatagagtaagtaaagaaaaagaatgtggaatttgctatgaagttgtttactcaaaacgatagatactttggtttattggattcgtgtaatcatatattttgcataacatgtatcaatatatggcataaaacacgaagagaaaccggtgcgtcggataattgtcctatatgtcgtacccgttttagaaacataacaatgagcaagttctataagctagttaactaataaataaaaagtttaatttgttgacgacgtatgtcgttatttttctcgtatgaaagattaaattcaattcaattcgttgtttctaatataatctgccgtattggatggattctcaagacaattgcatttagattatatcataaataaaaatagtagcacacaactacttcagcaaacattctttttataaatgccatctatcgtagtgaggacacaagtgaacctataatgagcaaatttattagtatcggttacatgaaggactttctgtagagtgacgattctaccatctatggtacgaacggtttcatcttctttgatgccatcacccagatgttctataaacttggtatcctcgtccgatctcatatcctttgccaaccaatacatgtagctaaaattaggcataaatttcacacatccagtgcaacgaaattctccagaagatgttacgatgtttaggttaggacatttgatttcgtcggcattaacatatgggtgaacacacccatacatgaaggcgatgagaaataggattctcatcttgccaaaatatcactagaaaaaatttatttatcaattttaaaggtataaaaaatacttattgttgctcgaatattttgtatttgatggtatacggaagattagaaatgtaggtattatcatcaactgattctatggttttatgtattctatcatgtttcactattgcgttggaaataatatcatatgcttccacatatattttattttgttttaactcataatactcacgtaattctggattattggcatatctatgaataattttagctccatgatcagtaaatattaatgagaacatagtattaccacctaccattatttttttcatctcattcaattcttaattgcaaagatctatataatcattatagcgttgacttatggactctggaatcttagacgatgtacagtcatctataatcatggcatatttaatacattgttttatagcatagtagttatctacgatgttagatatttctctcaatgaatcaatcacataatctaatgtaggtttatgacataatagcattttcagcagttcaatgtttttagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagaccctttttgtatgtataagtgtaaaaattataacattcatagttggatttacataggtgtccaatcgggatctctccatcatcgagataattgatggcatctcccttccttttttagtagatatttcatcgtgtaagaatcaatattaatatttctaaagtatccgtgtatagcctctttatttaccacagttccatattccactagagggatatcgccgaatgtcatatactcaattagtatatgttggaggacatccgagttcattgttttcaatatcaaaaagatggtttccttatcatttctccatagtggtacaatactacacattattccgtgaggctttccattctccaaaaacaatttgaccaaatctacatctttattgtatctataatcactatttagataatcagccataattcctcgagtgcaacatgttagatcgtctatatatgaataagcagtgttatctattcctttcattaacaatttaacgatgtctatatctatatgagatgacttaatataatattgaagagctgtacaatagtttttatctataaaagacggcttgattccgtgattaattagacatttaacaacttccggacgcacatatgctctcgtatccgactttgaatacagatgcaatacggtaccgcaatttcgtagttgataatcatcatacgcgtatcagtactcgtcctcataaagaacactgcagccattttctatgaacaaatcaataattttaggaacaggatcattgtcattacataattttctataactgaacgatggttttcacatttaacactcaagtcaaatccatgttctaccaacacctttatcaagtcaacgtctacatttttggatttcatatagctgaatatattaaagtcatttatgttgctaaatccagtggcttctagtagagccatcgctatatcctttaactttaacatgtctactatttgtgtattcttctaatggggtagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctctcaacatctgtttaagttcatcgagagccacctcctcattttccaaatagtcaaacattttgactgaatgagctactgtgaactctatacacccacacaactaatgtcattaaatatcatgtcaaaaacttgtacaattattaataaaaataatttagtgtttaaattttaccagttccagattttacacctccgttaaccccactggacgatcctcctccccacattccaccgccaccagatgtataagttttagatcctttattactaccatcatgtccatggataaagacactccacatgccgccactaccccctttagaagacatattaataagacttaaggacaagtttaacaataaaattaatcacgagtaccctactaccaacctacactattatatgattatagtttctatttttacagtaccttaactaaagtctctagtcacaagagcaatactaccaacctacactattatatgattatagtttctatttttataggaacgcgtacgagaaaatcaaatgtctaatttctaacggtagtgttgataaacgattatcgtcaatggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccgtaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctggaatatatttatctgccagtataacacaaatagtaatacatgtaaacccatattttgttattatattaatgtctgtgccattatctattaaccattctactaggctgacactatgcgacttaatacaatgataaagtatactacatccatgtttatctattttgtttatatcattaatatacggcttacaaagttttagtatcgataacacatccaactcacgcatagagaaggtagggaataatggcataatatttattaggttatcatcattgtcattatttacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattaggatattattacgtaaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctctttttcgtgtgaaattaaatagtttatcacgtccaaagatgtagcataaccatcttgtgacctagtaataatataataatagagaactgttttacccattctatcatcataatcagtggtgtagtcgtaatcgtaatcgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttttctacaatattaataccatttttgatactatttatttctatacctttcgaaattagtaatttcaataagtctatatcgatgttatcagaacatagatattcgaatatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcaataagatcaatctctagatctatagaatcaaaacacgataggtcagaagataatgaatatctgtaggcttcttgttgtactgtaacttctcgttttgttagatgtttgcatcgtgctttaacatcaatggtacaaattttatcctcgctttgtgtatcatattcgtccctactataaaattgtatattcagattatcatgcgatgtgtatacgctaacggtatcaataaacggagcacaccatttagtcataacagtaatccaaaattttttaaagtatatcttaacgaaagaagttgtgtcattgtctacggtgtatggtactagatcctcataagtgtatatatctagagtaatgtttaatttatcaaatggttgataatatggatcctcatgacaatttccgaagatggaaatgagatatagacacgcaataaatctaattgcggacatggttactccttaaaaaaatacgaataatcaccttggctatttagtaagtgtcatttaacactatactcatattaatccatggactcataatctctatacgggattaacggatgttctatatacggggatgagtagttctcttctttaactttatactttttactaatcatatttagactgatgtatgggtaatagtgtttgaagagctcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaatttcttgtaatcattcgaaataatttttagtttgcatccgtagttatcccctttatgtaactgtaaatttctcaacgcgatatctccattaataatgatgtcgaattcgtgctgtatacccatactgaatggatgaacgaataccgacggcgttaatagtaatttactttttcatctttacatattgggtactagttttactatcataagtttataaattccacaagctactatggaataagccaaccatcttagtataccacacatgtcttaaagtttattaattaattacatgttgttttatatatatcgctacgaatttaaacagagaaatcagtttaggaaaaaaaattatctatctacatcatcacgtctctgtattctacgatagagtgctactttaagatgcgacagatctgtgtcatcaaaaatatactccattaaaatgattattccggcagcgaacttgatattggatatatcacaacctttgttaatatctacgacaatagacagcagtcccatggttccataaacagtgagtttatctttctttgaagagatattttgtagagatcttataaaactgtcgaatgacatcgcatttatatctttagctaaatcgtatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttggatgaatagtatgtcttaataattgttattattttcattaattaatatttagtaacgagtacactctataaaaacgagaatgacataactagttatcaaagtgtctaggacgcgtaattttcatatggtatagatcctgtaagcattgtctgtattctggagctattttctctatcgcattagtgagttcagaatatgttataaatttaaatcgaataacgaacataactttagtaaagtcgtctatattaactcttttattttctagccatcgtaataccatgtttaagatagtatattctctagttactacgatctcatcgttgtctagaatatcacatactgaatctacatccaattttagaaattggtctgtgttacatatctcttctatattattgttgatgtattgtcgtagaaaactattacgtagaccattttctttataaaacgaatatatagtactccaattatctttaccgatatatttgcacacataatccattctctcaatcactacatctttaagattttcgttgttaagatatttggctaaactatataattctattagatcatcaacagaatcagtatatatttttctagatccaaagacgaactctttggcgtcctctataatattcccagaaaagatattttcgtgttttagtttatcgagatctgatctgttcatatacgccatgattgtacggtacgttatgataaccgcataaaataaaaatccattttcatttttaaccaatactattcataattgagattgatgtaatactttgttactttgaacgtaaagacagtacacggatccgtatctccaacaagcacgtagtaatcaaatttggtgttgttaaacttcgcaatattcatcaatttagatagaaacttatactcatcatctgttttaggaatccatgtattattaccactttccattatcccaggctatgtttcgtccatcatcgttgcgcagagtgaataattcttttgtattcggtagttcaaatatataatccatgcatagatcggtaaagctattgtagatgtgatttttcctaaatctaatataaaactcgtttactagcaaacactttcctgatttatcgaccaagacacatatggtttctaaatctatcaagtggtggggatccatagttatgacgcagtaacatatattattacattcttgactgtcgctaatatctaaatatttattgttatcgtattggattctgcatatagatggcttgtatgtcaaagatatagaacacataaccaatttatagtcgcgctttacattctcgaatctaaagttaagagatttagaaaacattatatcctcggatgatgttatcactgtttctggagtaggatatattaaagtctttacagatttcgtccgattcaaataaattactaaataatatcccacattatcatctgttagagtagtatcattaaatctattatattttatgaaaaatatatcacttgctcacctctatatttcgtacatttttaaactgtttgtataatatctctctgatatatttattgtgtcggtagacgataccgttacatttgaattaatggtgttccattttacaacttttaacaagttgaccaattcatttctaatagtatcaaactctccatgattaaatattttaatagtatccattttatatcactacggacacaaagtagctgacataaaccattgtataatttttatgttttatgtttattagcgtacacattttggaagttccggctgccatgtatttcctggagagcaagtagatgatgaggaaccagatagtttatatccgtacttgcacttaaagtctacattgtcgttgtatgagtatgatcttttaaacccgctagacaagtatccgtttgatattgtaggatgtggacatttaacaatctgacacgtgggtggatcggaccattctcctcctgaacacaggacaccagagttaccaatcaacgaatatccactattgcaactataagttacaacgctcccatcggtataaaaatcctcgtatccgttatgtcttccgttggatatagatggaggggattggcatttaacagattcacaaataggtgcctcgggattccataccatagatccagtagatcctaattcacaatacgatttagattcaccgatcaaatgatatccgctattacaagagtacgttatactagagccaaagtctactccaccaatatcaagttggccattatcgatatctcgaggcgatgggcatctccgtttaatacattgattaaagagtgtccatccagtacctgtacatttagcatatataggtcccattttttgctttctgtatccaggtagacatagatattctatagtgtctcctatgttgtaattagcattagcatcagtctccacactattcttaaatttcatattaatgggtcgtgacggaatagtacagcatgatagaacgcatcctattcccaacaatgtcaggaacgtcacgctctccaccttcatatttatttatccgtaaaaatgttatcctggacatcgtacaaataataaaaaagcccatatatgtttgctattgtagaaattgtttttcacagttgctcaaaaacgatggcagtgacttatgagtttcatctttagtaaacatatcataatattcgatattacgagttgacatatcgaacaaattccaagtatttgattttggataatattcgtattttgcatctgctataattaagatataatcaccgcaagaacacacgaacatctttcctacatggttaaagtacatgtacaattctatccatttgtcttccttaactatatatttgtatagataattacgagtctcgtgagtaattccagtaattacatagatgtcgccgtcgtactctacagcataaactatactatgatgtctaggcatgggagacttttttatccaacgatttttagtgaaacattccacatcgtttaatactacatatttttcatacgtggtataaactccacccattacatatatatcatcgtttacgaataccgacgcgcctgaatatctaggagtaattaagtttggaagtcttatccatttcgaagtgccgtgtttcaaatattctgccacacccgttgaaatagaaaattctaatcctcctattacatataactttccatcgttaacacaagtactaacttctgattttaacgacgacatattagtaaccgttttccattttttcgttttaagatctacccgcgatacggaataaacatgtctattgttaatcatgccgccaataatgtatagacaattatgtaaaacatttgcattatagaattgtctatctgtattaccgactatcgtccaatattctgttctaggagagtaatgggttattgtggatatataatcagagtttttaatgactactatattatgttttataccatttcgtgtcactggctttgtagatttggatatagttaatcccaacaatgatatagcattgcgcatagtattagtcataaacttgggatgtaaaatgttgatgatatctacatcgtttggatttttatgtatccactttaataatatcatagctgtaacatcctcatgatttacgttaacgtcttcgtgggataagatagttgtcagttcatcctttgataattttccaaattctggatcggatgtcaccgcagtaatattgttgattatttctgacatcgacgcattatatagttttttaattccatatcttttagaaaagttaaacatccttatacaatttgtggaattaatattatgaatcatagtttttacacatagatctactacaggcgtaacatcaattattacggcagcaactagtatcatttctacattgtttatggtgatgtttatcttcttccagcgcatatagtctaatagcgattcaaacgcgtgatagtttataccattcaatataatcacttcatcatttatatggtgctcctgaatgcgtttaaaaaaattatacggagacgccgtaataatttccttattcacttgtataatttccccattgatagaaaatatcacgctttccattcttgaagtactataagtaattatagtataatgtaaaggtttatatattcaatattttttataaaaaaatcatttcgacattaattcctttttaaatttccgtctatcatctatagaaacgtattctatgaatttataaaatgcttttacgtgtcctatcgtaggcgatagaaccgctaaaaagcctatcgaatttctacaaaagaatctgttatatggtatagggagagtataaaacattaaatgcccgtacttattaaagtattcagtagccaatcctaactctttcgaatacttattaatggctcttgttctgtacgaatctatttttttgaacaacggacctagtggtatatcttgttctatgtatctaaaataatgtctgactagatccgttagtttaatatcctcagtcatcttgtctagaatggcaaatctaactgcgggtttaggctttagtttagtttttatatctacatctatgtctttatctaacaccaaaaatataatagctaatattttattacaatcatccggatattcttctacgatctcactaactaatgtttctttggttatactagtatagtcacgatcagacaaataaagaaaatcagatgatcgatgaataatacatttaaattcatcatctgtaagatttttgagatgtctcattaaaatattattagggttagtactcattatcattcggcagctattacttattttattatttttcaccatatagatcaatcattagatcatcaaaatatgtttcaatcatcctaaagagtatggtgaatgactcttcccatctaatttctgaacgttcaccaatgtctctagccactttggcactaatagcgatcattcgcttagcgtcttctatattattaactggttgattcaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgattagttaacaactattttttatgttaaatcaattagtacaccgctatgtttaatacttattcatattttagtttttaggattgagaatcaatacaaaaattaatgcatcattaattttagaaatacttagtttccacgtagttaatgaaacatttgaactcatcgtacaggacgttctcgtacaggacgtaactataaaccggtttatatttgttcaagatagatacaaatccgataacttttttgacgaattctacgggatccactttaaaagtgtcataccgggttctttttatttttttaaacagatcaatggtgtgatgttgattaggtcttttacgaatttgatatagaatagcgttcacatatcctccataatggtcaatcgccatttgttcgtatgtcataaattctttaattatatgacactgtgtattgtttagttcatccttgttcattgttaggaatctatccaaaatggcaattatactagaactataggtgcgttgtatacacatattgatgtgtctgtttatacaatcaatgatatttggatccatgctactaccttcgggtaaaattgtagcatcatataccatttctagtactttaggttcattattatccattgcagaggacgtcatgatcgaatcataaaaaaatatattatttttatgttattttgttaaaaataatcatcgaatacttcgtaagatactccttcatgaacataatcagttacaaaacgtttatatgaagtaaagtatctacgatttttacaaaagtccggatgcataagtacaaagtacgcgataaacggaataataatagatttatctagtctatctttttctatagctttcatagttagatacatggtctcagaagtaggattatgtaacatcagcttcgataaaatgactgggttatttagtcttacacattcgctcatacatgtatgaccgttaactacagagtctacactaaaatgattgaacaatagatagtctaccattgttttgtattcagatagtacagcgtagtacatagcatcttcacaaattatatcattgtctaatagatatttgacgcatcttatggatcccacttcaacagccatcttaaaatcatattgctttcctttatcattaataatttctagaacatcatctctatcataaaagatacaaatattaactgtttgatccgtaataacattgctagtcgatagcaatttgttaataagatgcgctaggctcaatgtcttaataagaagtgtaagaggactatctccgaatttgttttgtttattaacatccgttgatggaagtaaaagatctataatgtctacatacttaactgttttagagcatacaatatggagaggtgtatttccatcatgatctggttttgagggactaattcctagtttcatcatccatgagattgtagaagcttttggattgtctgacataagatgtctatgaatatgatttttgccaaatttatccactatcctggcttcgaatccgatggacattatttttttaaacactctttctgaaggatctgtacacgccaacaacggaccacatccttcttcatcaaccgagttgttaatcttggctccatactgtaccaataaatttattctctctatgacttcatcatctgttcccgagagataatatagaggtgttttattatgtttatcacacgcgtttggatctgcgccgtgcgtcagcagcatcgcgactattctattattattaattttagaagctatatgcaatggataatttccatcatcatccgtctcatttggagagtatcctctatgaagaagttcttcgacaaatcgttcatctagtcctttaattccacaatacgcatgtagaatgtgataattatttccagaaggttcgatagcttgtagcatattcctaaatacatctaaatttttactattatatttggcataaagagatagataatactcggccgacataatgttgtccattgtagtataaaaattaatatttctatttctatttctgtatatttgcaacaatttactctctataacaaatatcataacttagttcttttatgtcaagaaggcactggtttagttcatctataaatgtcacgccataactaccacgcatgccatactcagaattatgataaagatatttatccttggggtgtaggtaatggggattaatctttgttggatcagtctctaagttaacacatgtcacacatgatccatttatagttatatcacacgatgatgatttatgaattgattccggaagatcgctatcgtattttgtggttccacaattcatttccatacatgttattgtcacactaatattgtgatgaactttatctagccgctgagtggtaaacaacagaacagatagtttattatctttaccaacaccctcagccgctgccacaaatctctgatccgtatccatgatggtcatgtttatttctagtccgtatccagtcaacactatgttagcatttctgtcgatatagctttcactcatatgacactcaccaataatagtagaattaatgtcataatttacaccaatagtgagttcggcggcaaagtaccaataccggtaatcttgtcgaggaggacatatagtattcttgtattctaccgaatacccgagagatgcgatacaaaagagcaagactaatttgtaaaccatcttactcaaaatatgtaacaatagtacgatgcaatgagtaagacaataggaaatctatcttatatacacataattattctatcaattttaccaattagttagtgtaatgttaacaaaaatgtgggagaatctaattagtttttctttacacaattgacgtacatgagtctgagttccttgtttttgctaattatttcatccaatttattattcttgactatatcgagatcttttgtataggagtcagacttgtattcaacatgcttttctataatcattttagctatttcggcatcatccaatagtacattttccagattagcagaatagatattaatgtcgtatttgaacagagcctgtaacatctcaatgtctttattatctatagccaatttaatgtccggaatgaagagaagggaattattggtgtttgtcgacgtcatatagtcgagcaagagaatcatcatatccacgtgtccattttttatagtgatgtgaatacaactaaggagaatagccagatcaaaagtagatggtatctctgaaagaaagtaggaaacaatacttacatcattaagcatgacggcatgataaaatgaagttttccatccagttttcccatagaacatcagtctccaatttttcttaacaaacagttttaccgtttgcatgttaccactatcaaccgcataatacaatgcggtgtttcccttgtcatcaaattgtgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgtatctttactagagagaaagcttttcagctgcttagacttccaagtattaattcgtgacagatccatgtctgaaacgagacgctaattagtgtatattttttcattttttataattttgtcatattgcaccagaattaataatatctctaatagatctgattagtagatacatggctatcgcaaaacaacatatacacatttaataaaaataatatttattaagaaaattcagatttcacgtacccatcaatataaataaaataatgattccttacaccgtacccatattaaggagattccaccttacccataaacaatataaatccagtaatatcatgtctgatgatgaacacaaatggtgtattaaattccagtttttcaggagatgatctcgccgtagctaccatgatagtagatgcctctgctacagttccttgttcgtcgacatctatctttgcattctgaaacattttataaatatataatgggtccctagtcatatgtttaaacgacgcattatctggattaaacatactaggagccatcatttcggctatcgacttaatatccctcttattttcgatagaaaatctagggagtttaagattgtacactttattccctaattgaaacgaccaatagtctaattttgcagccgtaatagaatctgtgaaatgggtcatattatcacctattgccaggtacatactaatattagcatccttatacggaaggcgcaccatatcatattcttcgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatacacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgcagacgataggtagacactgaacacgttaacgatagtatcaataacgcaatcatgattttatggtattaataattaaccttatttttatgttcggtataaaaattattgatgtctacacatccttttgtaattgacatctatatatccttttgtataatcaactctaatcactttaacttttacagttttccctaccagtttatccctatattcaacatatctatccatatgcatcttaacactctccgccaagatagcttcaaagtgaggatagtcaaaaagataaatatatagagcataatcattctcgtatactctgccctttattacatcacccgcattgggcaacgaataacaaaatgcaagcatcttgttaacgggctcgtaaattgggataaaaattatgtttttatatctattttattcaagagaatattcaggaatttctttttccggttgtatctcatcgcagtatatatcatttgtacattgtttcatattttttaatagtttacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatataggccgttttatcggttaccatatatttggcatggtttaccctagaatacggaatgggaggatcagcatctggtacaataaatagctttacttctatatctatgtttttagattttagcatagcgatagatcttaaaaagtttctcatgataaacgaagatcgttgccagcaactaatcaatagcttaacggatacttgtctgtctatagcggatcttcttaattcatcttctatataaggccaaaacaaaattttacccgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacaccacttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattctttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattgacggctactctaactcttactcctcttttgggtaattgtacaatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtctctgtaatcactgcgattgtattatccggattcattttatttgttaaaaaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctgaaacatcactaatctcattgtttgttccctggagtatgagagtcggggggtgttaatcttggaaattatttttctaaccttgttggtagccttcaagacctgactagcaaatccagccttaattttttcatgattgattaatgggtcgtattggtatttataaactttatccatatctctagatactgattctggacatagctttccgactggcgcatttggtgtgatggttcccataagtttggcagctagcagattcagttttgaaacagcatctgcattaactagaggagacattagaatcattgctgtaaacaagtttggattatcgtaagaggctagtatagaaattgttgctcccatggaatgacccaataagtagatttaatagttaccacgtgctgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaataggtttccaatatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtgagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtctattcgctaccataggaatatgtgctaaaatcactgaacattggggatacaaaaagatttcagaatctagattccaatcattgggaaacattacagatctgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaatttggttataaatgaaattgtcgccaatcttacacccaaccccttgttatccattagtatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcatgtactataccattatctatatcatctacataatctacgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcaaatcttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgattcacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatggatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttacagctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatctatttcttcgctttatataccacttaatgacaaaatcaactacataatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaagataaagtttatacaagtgtagatgataaattctacagaggttaatatagaagcacgtaataaattgacgacgttatgactatctatatatacctttccagtatacgagtaaataactatagaagttaaactgtgaatgtcaaggtctagacaaaccctcgtaactggatctttatttttcgtgtatttttgacgtaaatgtgtgcgaaagtaaggagataactttttcaatatcgtagaattgactattatattgccacctatagcatcaataattgttttgaatttcttagtcatagacaatgctaatatattcttacagtacacagtattaacaaatatcggcatttatgtttctttaaaagtcaacatctagagaaaaatgattatctttttgagacataactcccattttttggtattcacccacacgtttttcgaaaaaattagtttttccttccaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggatactgcatctgttataatatatctaacggtttcttcactcggtggatacaataaatgtttaaacatcaaacatgcgaaatcgcagtgcagaccctcgtctctactaattagttcgttggaaaacgtgagtccgggcattaggccacgctttttaagccaaaatatggaagcgaatgatccggaaaagaagattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcataatattggattgggaaaataacaaatctatttggatttggtgcaaggatgggttccataactaaattaacaatatcaataaattttttttcagttatctatatgcctgtacttggattttttgtacatcgatatcgccgcaatcactacaataattacaagtattattgatagcattgttattagtactatcataattaaattatcgacattcatgggtgctgaataatcgttattatcatcattatcattttgtaattgtgacatcatactaaataaatcgtttgcgagattgttgtgggaagcgggcatggaggatgcattatcattattatttaacgccttccatttggattcacaaatgttacgcacattcaacattttatggaaactataattttgtgaaaacagataacaagaaaactcgtcatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgttagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaattcattttcaattataatatactggtaatgaccattaaaataaaaatattcttcataaccggtaagaaagtgaaaagttcacattgaaactatgtcagtagtatacatcatgaaatgatgatatatatatactctattttggtggaggattatatgatataattcgtggataatcatttttaagacacatttctttattcgtaaatcttttcacgttaaatgagtgtccatattttgcaatttcttcatatgatggcggtgtacgtggacgaggctgctcctgttcttgttgtggtcgccgactgtcgtgtctgcgtttagatccctccattatcgcgattgcgtagatggagtactattatataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttggccgggcggagccgaacattctccgatatccaatttctgtatatctataatattattaacctccgcatacgcattacagttcttttctagcttggatactacactaggtacatcatctagatctattcctatttcctcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgttttggtacacatgatgaattcttctaatgctgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcagcatggtagttcgtaaattttaatgtataacagagccatctgtaaaaagataaactttatgtattgtaccaaagatttaaatcctaatttgatagctaactcggtatctactttatctgcagaatacagtgctaggggaaaaattataatatttcctctttcgtattcgtagttagttctcttttcatgttcgaaaaagtgaaacatgcggttaaaatagtttataacattaatattactgttaataactgccgggtaaaagtgggatagtaatttcacgaatttgatactgtcctttctctcgttaaacgcctttaaaaaaactttagaagaatatctcaatgagagttcctgaccatccatagtttgtatcaataatagcaacatatgaagaacccgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccctattaaaattcttaaaataatttaacaatctaactgacggagcccaattttggtgtaaatctaattgggacattatattgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaactattaactattttgtctctgtttttaatttctttagtaatgaaattattcacaatatcagtatcttctttatctaccagagattttactaacttgataaccttggctgtctcattcaatagggtagtaatatttgtatgtgtgatattgatatctttttgaattgtttcttttagaagtgattctttgatggtgccagcatacgaattacaataatgcagaaactcggttaacatgcaggaattatagtaagccaattccaattgttgcctgtgttgtattagagtgtcaatatgagcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctactgacgatagtatctccttgacagatattggaccgaattacagaagtacctggaatgtaaagccctgaaaccccctcattttttaagcagattgttgccgtaaatcctgcactgtgaccaagatagagagctcctttggtgaatccatctctatgtttcagtttaaccaagaaacagtcagctggtctaaaatttccatctctatctaatacagcatctaacttgatgtcaggaactatgaccggtttaatgttatatgtaacattgagtaaatccttaagttcataatcatcactgtcatcagttatgtacgatccaaacaatgtttctaccggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcaatggaatgcaaaaccccatagtgaaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtatagaacaacgaaattatactagagttgttaaagttaatattttctatgagctgttccaataaattatttgttgtgactgcgttcaagtcataaatcatcttgatactatccagtaaacagtctttaagttctggaatattatcatcccattgtaaagcccctaattcgactatcgaatatcctgctctgatagcagtttcaatatcgacggacgtcaatactgtaataaaggtggtagtattgtcatcatcgtgataaactactggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattatttactataatataatctagacagatagatgattcgataaatagaaaaggtatatcgttggtaggataatacatccccattccagtattctcggatactctattaatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacagttattgggccagtatactgttagcaacggtatatcgaatagattactcatgtaacctactagaatgatagttcgtgtactagtcataatatctttaatccaatctaagaaatataaaattagatcttttacactgttaaagttaacaaaggtattacccgggtacgtggatatcatatatggtattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagagaacttacgatacatctgtttcctgtaatcgttaaattttacaaatctataacatgctaaaccttttgacgacaaccattcattaatttctgatatggaatctgtattctcgataccgtattgttctaaagccagtgctatatctccctgttcgtgggaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatcttgtaatattcatcatcgacataatactatctatgttatcatcgtatattagtataccatgaccttcttcatttcgtgccaaaataatatacagtcttaaataattacgcaatatctcaatagtttcataattgttagctgttttcatcaaggtttgtatcctgtttaacatgatggcgttctatacgtttctattttctattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcgtctagacttctggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagctgacctgagtttatcaataactacatcggtatctaaatctctagaatatcccaataggtgttccggagaatcagtaaagaacactccacctataggattcttaatatgatacgcagtgctaactggcaaacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcatcatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccgatgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtttatttctatatccgtatccattgtagattgttgaccgattatcgagtttaaatcattactaatactcaatccttcagaatacaatctgtgtttcattgtaaatttataggcggtgtatttaagttggtagattttcaattatgtatcaatatagcaacagtagttcttgctcctccttgattctagcatcctcttcattattttcttctacgtacataaacatgtccaatacgttagacaacacaccgacgatggcggccgccacagacacgaatatgactaaaccgatgaccatttaaaaacccctctctagctttcacttaaactgtatcgattattcttttagaacatgtataatataaaaacattattctatttcgaatttaggcttccaaaaatttttcatccgtaaaccgataataatatatatagacttgttaatagtcggaataaatagattaatgcttaaactatcatcatttccacgattagagatacaatatttacattttttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatccttttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacaaatcgtcgaaaactagttatagttaacattttattatttgataccctgatattaatacccctgccgttactattatttataactgatgtaacccacgtaacattagaattaattatcgatagtaatgcatcaacgcttccaaaattgtctattataaactcaccgataatttttttattacatgttttcatattcattaggattatcaaatctttaatcttactacgattgtatgcgttgatattgcaagacgtcattctaaaagacggaggatctccatcaaatgccaaacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacactagtcacaatcaccactttcatatttagaatatatgtatgtaaaaatatagtagaatttcattttgtttttttctatgctataaatgaattctcattttgcatctgctcatactccgttttatatcaataccaaagaaggaagatatctggttctaaaagccgttaaagtatgcgatgttagaactgtagaatgcgaaggaagtaaagcttcctgcgtactcaaagtagataaaccctcatcacccgcgtgtgagagaagaccttcgtccccgtccagatgcgagagaatgaataaccctggaaaacaagtcccgtttatgagaacggacatgctacaaaatatgttcgcggctaatcgcgacaacgtggcgtcgagacttttgaactaaaatacaattatatctttttcgatattaataaatccgtgtcgcccgggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtgacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtgataaattttattagaaaggccaaatctataagaaaagtcctagaattagtctgaagaatatctatatcgccgtatagtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtatcaacatcggaaaaaaatctttttttattcttttttactaaagatacaaatatgtctttgttaaaaacagttattttctgaatatttctagcttgtaattttaacatatgatattcgttcacactaggtactctgcctaaataggtttctataatctttaatgtaatattaggaaaagtattctgatcaggattcctattcattttgaggatttaaaactctgattattgtctaatatggtctctacgcaaactttttcacagagcgatagagtttttgataactcgtttttcttaagaaatataaaactactgtctccagagctcgctctatcttttattttatctaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaattttattcttcgctcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttgtttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatatttcttaatgtaaagagtgatcaaatcattgtgtttattgtaccatcttgttgtaaatgtgtattcggttatcggatctgctcctttttctattaaagtatcgatatcgatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtattttgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacttgatgttcatatattggttcatacatgaaatgatctctattgatgatagtgactatttcgttctctgaaaattggtaactcattttatatatgctttccttgttgatgaaggataggatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacgaattctacaacattattataaaggactttgggtagataagtgggatgaaatcctattttaattaatgctatcgcattgtcctcgtgcaaatatccaaacgcttttgtgatagtatgacattcattatctagaaacgctctacgaatatctgtcacagatatcatctttagagaatactagttgcgttaatagtactaaaatttgtattttttttaatatatctcaaaaaaaattaatatttatggatccgatgtataattagaatcagaatctaatgatgacgtacccaagaagtttatctacagccaatttagctgcattatttttagcatctcgtttagattttccatcggccttatcgaatactcttccgtcgatatctacacaggcataaaatgtaggagagttactaggcccaactgattcaatacgaaaagaccaatctctcttagttatttggcagtactcattaataatggtgacagggttagcatctttccaatcaataatttttttagccggaataacatcatcaaaagacttatgatcctctctcattgatttttcgcgggatacatcatctattatggcgtcagccataacatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatgtttttaatagccgcacacacaatctctgcgtcagaacgctcgtcaatatagatcttagacatttttagagagaactaacacaaccagcaataaaactgaacctactttatcatttttttattcatcatcctctggtggttcgtcgttcctatcgaatgtggatctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcatgtctaactagtggaggttcgtcagcggctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatatgttaataattgtattgtggttatacggctacaatttcataatgagtggaagtcagtgtccgatgatcaatgacgatagctttactctgaaaagaaagtatcaaatcgatagtgcggagtcaacaatgaaaatggataagaagaggacaaagtttcagaatagagccaaaatggtaaaagaaataaatcagacaataagagcagcacaaactcattacgagacattgaaactaggatacataaaatttaagagaatgattatgactactactctagaagatatagcaccatctattccaaataatcagaaaacttataaactattctcggacatttcagccatcggcaaagcatcacggaatccaagtaagatggtatatgctctgctgctttacatgtttcccaatttgtttggagatgaccatagattcattcgttatagaatgcatccaatgagtaaaatcaaacacaagatcttctctcctttcaaacttaatcttattagaatattagtggaagaaagattctataataatgaatgcagatctaataaatggaacacaagttgataaaatgttgatagctgaatctgataaatatacaatagatgcaaggtataacctaaaacccatgtatagaatcaagggagaatctgaagaagataccctcttcatcaaacagatggtagaacaatgtgtgacatcccaggaattggtggaaaaagtgttgaagatactgtttagagatttgttcaagagtggagaatacaaagcatacagatacgatgatgatgtagaaaatggatttattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagtgataaaatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcttacctaagcaagaaagatacaggcatagagtttgcggataatgatagacaagatatatacactctatttcaacaaactggtagaatagtccatagcaatctaacagaaacgtttagagattatatctttcccggagataagactagctattgggtgtggttaaacgaaagtatagctaatgatgcggatattgttcttaatagacacgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgataaaacgtttaacgaggacttattcagagttgttgttcaaataaatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttgagagataatctatatcatgtagaagaattcttggataaaagcatccatctaaccaagacggataagaaatatatacttcaattgataagacacggtagatcatagaacagaccaaatatattattaataatttgtatatacatagatataattatcacatattaaaaattcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcggagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattagcatcttattagaatattaacctaactaaaagacataacataaaaactcattacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacctagatgctagtgactattatcccatttcgttgggattacttaaaaagtttgagtttctcatgtctctatataaaggtcctattcccgtatatgaagaaaaagtaaatactgaattcattgctaatggatctttctccggtagatatgtatcatatcttagaaagttttctgctcttccaacaaacgagtttattagttttttgttactgacttccattccaatctataatatcttgttctggtttaaaaatactcagtttgatattactaaacacacattattcagatacgtctatacagataatgccaaacacctggcgttggctaggtatatgcatcaaacaggagactataagcctttgtttagtcgtctcaaagagaattatatatttaccggtcccgttccaataggtatcaaagatatagatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtttcatatgttttaatatttacaagttttttggtccatggtccattaggacaaatatatgcaaaataatatcgttctccaagttctatagtctctggattatttttattatattcagtaaccaaatacatattagggttatctgcggatttataatttgagtgatgcattcgactcaacataaataattctagaggagacgatctactatcaaattcggatcgtaaatctgtttctaaagaacggagaatatctatacatacctgattagaattcatccgtccttcagacaacatctcagacagtctggttttgtacatcttaatcatattcttatgaaacttggaaacatctcttctagtttcactagtacctttattaattctctcaggtacagattttgaattcgacgatgctgagtatttcatcgttgtatatttcttcttcgattgcataatcagattcttatataccgcctcaaactctattttaaaattattaaacaatactctattattaatcagtcgttctaactctttcgctatttctatagacttatcgacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttaacatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaatagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacataatagtacgactttaaatccattttcccaaatatctttacgaattactttacatataatatcctcatcaacagtcacataattacctgtggttaaaacctttgcaaatgcagcggctttgcctttcgcgtctgtagtatcgtcaccgatgaacgtcatttctctaactcctctatttaatactttacccatgcaactgaacgcgttcttggatatagaatccaatttgtacgaatccaatttttcagatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataatcttctctcctgttaataactctagacgattagtaatatatctcagatcaaagttatgtccgttaaaggtaacgacgtagtcgaacgttagttccaacaattgtttagctattcgtaacaaaactatttcagaacatagaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtaactacgtaataaaagtaatgaggaaatcgtataaatacggtctcaccatttcgacatctggatttcagatataaaaatctgttttcaccgtgactttcaaaccaattaatgcaccgaacatccatttctagaatttagaaatatattttcatttaaatgaatcccaaacattggggaagagccgtatggaccattatttttatagtactttcgcaagcgggtttagacggcaacatagaagcgtgtaaacgaaaactatatactatagtcagcactcttccatgtcctgcatgtagacggcacgcgactatcgctatagaggacaataatgtcatgtctagcgatgatctgaattatatttattattttttcatcagattatttaacaatttggcatctgatcccaaatacgcaatcaatgtgtcaaaggttaaccctttataaacttaacccattataaaacttatgattagtcacaactgaaataaccgcgtgattattttttggtataattctacacggcatggtttctgtgactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacagatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgtccaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatagagtgtccgtataccaacatgtctgatattttgatgtattccattaaattatttagttttttctttttattttcgttaaacagcatttctgtcaacggaccccaacatcgttgaccgattaagttttgattgatttttccgtgtaaggcgtatctagtcagatcgtatagcctatccaataatccatcatctgtgcgtagatcacatcgtacactttttaattctctatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacagggattaagacggaaagatgaaatgattctctcaacatcttcaatggataccttgctattttttctggcattatctatatgtgcgagaatatcctctagagaatcagtatcctttttgatgatagtggatctcaatgacatgggacgtctaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatctacatcagttttgtattccaaattaaacatggcaacggatttaattttatattcctctattaagtcctcgtcgataataacagaatgtagataatcatttaatccatcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagcgtagctcctacaggaatatctttaactaagtcaatgatttcatcaaccgttagatctattttaaagttaatcatataggcattgatttttaaaaggtatgtagccttgactacattttcattaattaaccattccaagtcactgtgtgtaagaagattatattctatcataagcttgactacatttggtcccaataccattaaagaattcttatgatataaggaaacagcttttaggtactcatctactctacaagaattttggagagccttaacgatatcagtgacgtttattatttcaggaggaaagaatctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattattttctcaacaagttctcaataccccaatagatgatagaatatcacccaatgcgtccatgttgtctatttccaacaggtcgctatatccaccaatagaagttttcccaaaaaagattctaggaacagttctaccaccagtaatttgttcaaaataatcccgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctgcaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatcgatggcattaagaattcgtttttcgacatctgtcaaaaccaattcctttttgcctgtatcatccagttttccatcctttgtaaagaaattattttctactagactattaataagactgataaggattcctccataattgcacaatccaaactttttcacaaaactagactttacaagatctacaggaatgcgtacttcaggtttcttagcttgtgattttttcttttgtggacattttcttgtgaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaataccaaccccaacaaccggtattattagttgatgtggtagttttctcatcacttagaacagatttaacaatttctataaagtctgtcaaatcatctttcggagaacccatatatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagtgcgaatgtaatttttgtttccgttccggatctatagaaaactacaggtgtgataattgccttggccaattgtctttctcttttactgagtgattctagttcaccttctatagatctgagaatggatgattctccagtcgaaacatattctaccatggatccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcgcaaaccaccagtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaattatttaacttttcattaatagggatttgacgtatgtagcgtacaaaattatcgttcctggtatatagataaagagtcctatatatttgaaaatcgttacggctcgattaaactttaatgattgcatagtgaatatatcattaggatttaactccttgactatcatggcggcgccagaaattaccatcaaaagcattaatacagttatgccgatcgcagttagaacggttatagcatccaccatttatatctaaaaattagatcaaagaatatgtgacaaagtcctagttgtatactgagaattgacgaaacaatgtttcttacatatttttttcttattagtaaccgacttaatagtaggaactggaaaactagacttgattattctataagtatagatacccttccaaataatattctctttgataaaagttccagaaaatgtagaattttttaaaaagttatcttttgctattaccaagattgtgtttagacgcttattattaatatgagtgatgaaatccacaccgcctctagatatcgcttttatttccacattagatggtaaatccaatagtgaaactatctttttaggaatgtatggactcgcgtttagaggagtgaacgtcttgggcgtcggaaaggatgattcgtcaaacgaataaacaatttcacaaatggatgttaatgtattagtaggaaattttttgacgctagtggaattgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatccggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaatggagtaaaataaatatcattaatatatgctctaaatattagtatttttattaatcctttgattatcatcttctcgtacgcgaatgattccatgatcaagagtgatttgagaacatcctccggagtattaatgggcttagtaaacagtacatcgttgcaataataaaagttatccaagttaaaggatattatgcattcgtttaaagatatcacctcatctgacggagacaattttttggtaggttttagagactttgaagctacttgtttaacaaagttattcatcgtcgtttactattctatttaattttgtagttaatttatcacatatcacattaattgactttttggtccacttttccatacgtttatattcttttaatcctgcgttatccgtttccgttatatccagtgatagatcgtgcaggttaaatagaatgctcttaaataatgtcattttcttatccgctaaaaatttaaagaatgtataaacctttttcagagatttgaaactcttaggtggtgtcctagtacacaatatcataaacaaactaataaacattccacattcagattccaacagctgattaacttctacattaatacagcctattttcgctccaaatgtacattcgaaaaatctgaataaaacatcgatgtcacaatttgtattatccaatacagaatgtctgtgattcgtgttaaaaccatcggagaaggaatagaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaagaaatacgctaacggtatactagtaggtaactcaaagacatcatatatagaatggtaacgcgtctttaactcgtcggttaactctttcttttgatcgagttcgtcgctactattgggtctgctcaggtgccccgactctactagttccaacatcataccgataggaatacaagacactttgccggcggttgtagatttatcatatttttccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccacgaaacaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatatttttagcgtggatttctcatagacctgtagttttaactggaggaactggagtgggtaagacgtcacaggtacccaagttattgctttggtttaattatttatttggtggattctctactctagataaaatcactgactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgacagggaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggttttagatatagacgaaatattagaaaaagtgtattcatcacctaatgtatcgataattatttctactccttatttggaatccagcgttactatacacaatgttacacacatttatgatatgggtagagtttttgtccccgctccttttggaggatcgcaacaatttatttctaaatctatgagagatcaacgaaaaggaagagtaggaagagttaatcctggtacatacgtctatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataattttgagaggacgggagaattaactagtattgtacaagaagccattttatctctaaatttacgaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaattaaactctaatgaccacatctttttttagagatgaaaaattttccacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtacctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaatcagtccatcattggttgcgtcaagaactactatcggatgttgttgggtatctctagtgttacacatggccttactaaagtttgggtaaataactatgatatctctattaattatagatgcatatatttcatttgtcaaggatattagtatcgacttgctatcgtcattaatacgtgtaatgtaatcatataaatcatgcgatagccaaggaaaatttaaatagatgttcatcatataatcgtcgctataattcatattaatacgttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagatgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgttcaacttgtccaaattcctacttacagaagatgaggaatcgttggagatagtgtcttccttatgtagaggatttgaaatatcttatgatgacttgataacttactttccagataggaaataccataaatatatttataaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagggaagcaaatgatgacttgatagaatatctcctcaaggaatacactcctcagatttatacatattctaatgagcgagttcccatagctggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaacaggtggccaaactccataggtagctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcaaagtttcctattagggttccgcgctttacgtcacccagcatacttgaatcaccatcctttaaaaaaaatgataagatatcaacatggagtatatcatactcggattttaattcttctactgactcactgacattttcacaaatactacaatacggtttaccgaaaataatcaatacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgttagaattagaaaagtgtacatccgaaatacaaaatgttaccggatttatggaagaagaaataaaggcaaaaatgcaattaaaaatcgataaacttacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctgctgataatcatcctaagatgataaaaaacttaactcaactgtttaaatatgttccatctgcagaggataactatttagcaaaattaacggcgttagtgaatggatgtgatttctttcctggactctatggggcatctataacacccaacaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatgttcctccttgtcaatgcactgttcaagaatttatattttccgcattagatgaaaaatggaacaattttaaatcatcttatttagagaccgttccgttaccctgtcaattaatgtacgcgttagaaccacgtaaggagattgatgtttcagaagttaaaactttatcatcttatatagatttcgaaaatactaaatcagatatcgatgttataaaatctatatcctcgatttttggatattctaacgaaaactgtaacactatagtgttcggcatctataaggataatttactactgagtataaatagttcattttactttaacgatagtctgttaataaccaatactaaaagtgataatataataaatataggttactagattaaaaatggtgttccaactcgtgtgctctacatgcggtaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctaatacgtcattaactttattgggtattccgtatggatttggtcataatagaatgtattgttttaaattggtagctgaatgttataaaaatgccggtattgatacatcgtctaaacgaatattgggcaaagatatttttctgagccaaaacttcacagacgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttcttgctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtaaataccattaatcactgattcctttttcgatgccggacaatagcacaattgtttagctttggactctatgtattcagaattaatagatatatctcttaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtgtctataaatgtagactcgacggatgagttaatgtatatttttgccgccttgggcggatctgtaaacatttgggccattatacctctcagtgcatcagtgttctaccgcggagccgaaaatattgtgtttaatcttccggtgtccaaggtaaaatcgtgtttgtgtagttttcacaatgatgccatcatagatatagaacctgatctgaaaaataatctagtaaaactttctagttatcatgtagtaagtgtcgattgtaacaaggaactgatgcctattaggacagatactactatttgtctaagtatagatcaaaagaaatcttatgtgtttaattttcacaagtatgaagaaaaatgttgtggtagaaccgtcattcatctagaatggttgttgggctttatcaagtgtattagtcagcatcagcatctggctattatgtttaaagatgacaatattattatgaagactcctggtaatactgatgcattttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattttaggaatgttgttttcggatagagttcaatcctttaagatcaacatctttatggcgtttttagattaatactttcaatgagataaatatgggtggcggagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaaaaaggatggaaagatatcagataagtatgaagagggtgcagtattagaatcgtgttggccagacgttcacgacactggaaaatgcgatgttgatttattcgactggtgtcagggggatacgttcgatagaaacatatgccatcagtggatcggttcagcctttaataggagtgatagaactgtagagggtcaacaatcgttaataaatctgtataataagatgcaaacattatgtagtaaagatgctagtgtaccaatatgtgaatcatttttgcatcatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttgctaacacgtaattataataatttaggactttgcaatattgtacgatgtaataccagcgtgaacaacttacagatggataaaacttcctcattaagattgtcatgtggattaagcaatagtgatagattttctactgttcccgtcaatagagcaaaagtagttcaacataatattaaacattcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaacgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtgccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaagcgttgatgcaattgacgactaaggccactactcaaatagcacctagacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcgctgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggtggtgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctgtagcatactttttctttaccttgagaatatccatcgtttgcttggtcaatagcgatatgtgattttttatcaaccactcgaaaaagtaattggagtgttcatatcctctacgggctattgtctcatggccgtgtatgaaatttaagtaacacgactgtggtagatttgttctatagagccggttgccgcaaatagatagaactaccaatatgtctgtacaaatgttaaacattaattgattaacagaaaaaacaatgttcgttctgggaatagaaaccagattaaaacaaaattcgttagaatatatgccacgtttatacatggaatataaaataactacagtttgaaaaataacagtatcatttaaacatttaacttgcggggttaatttcacaactttactgtttttgaactgttcaaaatatagcatcgatccatgagaaatacgtttagccgcctttaatagaggaaatcccaccgcctttctggatctcaccaacgacgatagttctgaccagcaactcatttcttcatcatccacctgttttaacatataataggcaggagatagatatccgtcattgcaatattccttctcgtaggcacacaatctaatattgataaaatctccattctcttctctgcatttattatcttgtttcggtggctgattaggctgtagtcttggtttaggctttggtatatcgttgttgaatctattttggtcattaaatctttcatttcttcctggtatatttctatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgaaaatatcacaggagcaatgtttaccacaatgtataatataagaaacaatttgggtctaggcgatgataaactaactattgaagccattgaaaactatttcttggatcctaacaatgaggttatgcctcttatcattaataatacggatatgactgccgtcattcctaaaaaaagtggtaggagaaagaataagaacatggttattttccgtcaaggatcatcacctatcttgtgtattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccatgagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcgttgtattcattctaatatatgtattttttagatctgaattaaatatgttcttcatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagccgtgggtcattgttatgaatctctttcagaggaatacagacaattgacaaaattcacagactctcaagattttaaaaaactgtttaacaaggtccctattgttacagatggaagggtcaaacttaataaaggatatttgttcgactttgtgattagtttgatgcgattcaaaaaagaatcagctctagctaccaccgcaatagatcctgttagatacatagatcctcgtcgcgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgttgaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacatcgactcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatctgctcccggtacacatatacgttatttgagagatcatttctataatttaggagtgatcatcaaatggatgctaattgacggccgccatcatgatcctattttaaatggattgcgtgatgtgactctagtgactcggttcgttgatgaggaatatctacgatccatcaaaaaacaactgcatccttctaagattattttaatttctgatgtgagatccaaacgaggaggaaatgaacctagtacggcggatttactaagtaattacgctctacaaaatgtcatgattagtattttaaaccccgtggcatctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaagtatctagcaaagattttatgtctaaaaacagaaatagcaagagatccgtacgcagtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggtgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataatcaataatattatcttatatcttgtttagaaaaatgctaatattaaaatagctaacgctagtaatccaatcggaagccatttgatatctataatagggtatctaatttcctgattcagatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattatttttatagttgtaataaaaagggaaatttgattgtatactttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaagacttgtgggaaaacggaattggaatgtttcggtcactggggtaaagtaagtatttataaaactcatatagttaagcctgaatttatttcagaaattattcgtttactgaatcatatatgtattcactgcggattattgcgttcacgagaaccgtattccgacgatattaacctaaaagagttatcgggacacgctcttaggagattaaaggataaaatattatccaagaaaaagtcatgttggaacagtgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgttgattattagaccggctattagtttttggatagatagtatacccaaagaaaccaatgaattaacttacttattaggtatgatcgttaagaattgtaacttgaatgctgatgaacaggttatccagaaggcggtaatagaatacgatgatattaaaattatttctaataacactaccagtattaatttatcatatatcacatccggcaaaaataatatgattagaagttatatcgtcgcccggcgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcatcaaaccaagttaaattttactttaataaacgattaaaccaattaacaagaatacgccaaggaaagtttattaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgatttcgacggggatgaggaatggatgatattagaacaaaatcctaaagctgtaattgaacaaagtattcttatgtatccgacgacgttactcaaacacgatattcatggagcccctgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcccacagaactaatgtatattctaggtacttatggacaacagaggattgatggtgaaccagcagagactcgagtattgggtagagttttaccttactatcttccagactctaaggatccagaaggaagaggttatattcttaattctttaacaaaaggattaacaggttctcaatattacttttcgatgctggttgcaagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaaaaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccaaacatcactcttcgaaaagaaacagataaatatgtagtagatataatagttaatagattatacatcaagagagcagaaataaccgaattagttgtcgaatatatgattgaacgatttatctcctttagcgtcattgtaaaggaatggggtatggagacattcattgaggacgaggataatattagatttactgtctatctaaatttcgttgaaccagaggaattgaatcttagtaagtttatgatggttcttccgggggcagccaacaagggaaagattagtaaattcaagattcctatctctgactatacgggatatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcaatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttacccttgtcattatagtgggagatttggctctgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatattcgaattcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagcttagatttaacgttaaagatgagcataaacataataaacaaaattacaatcaaacctataacattaatatcaaacaatccaaaaaatgaaatcagtggagtagtaaacgcgtacataactcctggataacgtttagcagctgccgttcctattctagaccaaaaattcggtttcatgttttcgaagcggtgttctgcaacaagtcggggatcgtgttctacatatttggcggcgttatccagtatctgcctattgatcttcatttcgttttcgattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcgttgtcctttacatcatcgaacttctgatcattaatatgctcatgaacattaggaaatgtttctgatggaggtctatcaataactggcacaacaataacaggagttttcaccgccgccatttagttattgaaattaatcatatacaactctttaatacgagttatattttcgtctatccattgtttcacatttacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcaatttctatttttagatgtgatggaaaaatgactaattttgtagcattagtatcatgaactctaatcaaaatcttaatatcttcgtcacacgttagctctttgaagtttttaagagatgcatcagttggttctacagatggagtaggtgcaacaattttttgttctacacatgtatgtactggagccattgttttaactataatggtgcttgtatcgaaaaactttaatgcagatagcggaagctcttcgccgcgactttctacatcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatgtcatataggaaactataaagtccgcactactgttaagaatgattactaacgcaactatatagttcaaattaagcattttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaagaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtataataactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttagttggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgaaataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacaaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcggcgacattgtagaaagcgtggctgctgtagagctcgatgatagcgacggggatgatgaacctatggtacaagttgaagctggtaaagtaaatcatagtgctagaagcgatctttctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtattagatgataatccagcgtatgaggttttgcaacatgttaaaattcctactcatttaacagatgtagtagtatatgaacaaacgtgggaagaggcattaactagattaatttttgtgggaagcgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccgtcaccaaaaaagttaatagcattaactatcaaacaaactgctgaagttgtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtataaaatctctcgcaatgaccgctttctttggggagctaagcacattagatattatggcattgataatgtctatatttaaacgccatccaaacaataccattttttcagtggataaggatggtcagtttatgattgatttcgaatacgataattataaggcttctcaatatttggatctgaccctcactccgatatttggagatgaatgcaagactcacgcatcgagtatagccgaacaattggcgtgtgcggatattattaaagaggatattagcgaatacatcaaaactactccccgtcttaaacgatttataaaaaaataccgcaatagatcagatactcgtatcagtcgagatacagaaaagcttaaaatagctctagctaaaggcatagattacgaatatataaaagacgcttgttaataagtaaatgaaaaaaaactagtcgtttataataaaacacgatatggatgccaacgtagtatcatcttctactattgcaacgtatatagacgctttagcgaagaatgcttcagaattagaacagaggtctaccgcatacgaaataaataatgaattggaactagtatttattaagccgccattaattactttgacaaatgtagtgaatatctctacgattcaggaatcgtttattcgatttaccgttactaataaggaaggtgtcaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccaatctaaaagttctttgttgcacgctattaatcatccaaagtcaaggcctaatacatctctggaaatagaattcacacctagagacaatgaaacagttccatatgatgaactaataaaggaattgacgactctctcgcgtcatatatttatggcttctccagagaatgtaattctttctccgcctattaacgcgcctataaaaacctttatgttgcctaaacaagatatagtaggtttggatctggaaaatctatatgccgtaactaagactgacggcattcctataactatcagagttacatcaaacgggttgtattgttattttacacatcttggttatattattagatatcctgttaagagaataatagattccgaagtagtagtctttggtgaggcagttaaggataagaactggactgtatatctcattaagctaatagagcccgtgaatgctatcagtgatagactagaagaaagtaagtatgttgaatctaaactagtggatatttgtgatcggatagtattcaagtcaaagaaatacgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatatccccgttctaaatgcattaaataattccaatagagcgatttttgttcctataggaccttccaactgtggatactctgtattgttaatagatatattaatacttttgtcgggtaacagaggttctacgtcttctaaaaataaaagtttgataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtcgataacgacgataacgaagtatttatacttttaggaaatcacaatgactttatcagattaaaattaacaaaattaaaggagcatgtatttttttctgaatatattgtgactccagatacatatggatctttatgcgtcgaattaaatgggtctagttttcagcacggcggtagatatatagaggtggaggaatttatagatgctggaagacaagttagatggtgttctacatccaatcatatatctaaagatatacccgaagatatgcacactgataaatttgtcatttatgatatttatacgtttgattcgttcaagaataaacgattggtattcgtacaggtgcctccatcattaggagatgatagctatttgactaatccgttattgtctccgtattatcgtaattcagtagccagacaaatggtcaatgatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgcggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatctactgggataagatttccaagttactgctgcagcatataactaaacacgttagtgttctttattgtttgggtaaaacagatttctcgaatatacgggccaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcaactattagaggtaatgatgttatttttgtccttaagactataggtgtcccatcagcatgtagacaaaatgaagatccaagattcgtagaagcatttaaatgcgacgagttaaaaagatatattgagaataatccagaatgtacactattcgaaagtcttagggatgaggaagcatactctatagtcagaattttcatggatgtagatttagacgcgtgtctagacgaaatagattatttaacggctattcaagattttattatcgaggtgtcaaactgtgtagctagattcgcgtttacagaatgcggtgccattcatgaaaatgtaataaaatccatgagatctaatttttcattgactaagtctacaaatagagataaaacaagttttcatattatctttttagacacgtataccactatggatacattgatagctatgaaacgaacactattagaattaagtagatcatctgaaaatccactaacaagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacgacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccaagaaaacgaaagactgtagaagctaacatacgagacatgttagtagattcagtggagaccgatacctatccggataaacttccgtttaaaaatggtgtattggacctggtagacggaatgttttactctggagataatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagttgtacgaaaaaactttatctagttgtttatgcggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgacaatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatagatatagattcgcatttctatacttgttggtgaaatggtacagaaaatatcatgttcctattatgaaactatatcctacaccggaagagattccggactttgcattctatctcaaaataggtactctgttggtatctagctctgtaaagcatattccattaatgacggacctctccaaaaagggatatatattgtacgataatgtggtcactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgccgaacatcaacatcttaaaaattttcaattataatatgggtgtagctatgaacttgtttaatgacaaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttttactattgtctggatctcccattactaacacacctaatactctgggtcatattatagatttaatgtccgaagagacgatagattttggtgaaattattagtcgtggtaagaaagtaattcagacacttcttaacgaacgcggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttatcaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggcagtcaattgatgtttttgttttcgtcaaacattatgtccgaatcctatactctgaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtgacgtcattaaacgattacacacaggatgaattaattaatgttttaccatttgacatcaaaaagctgttatatctaaaatttaagacgaaagaaacgaatagaatatactctattcttcaagagatgtctgaaacgtattctcttccaccacatccatcaattgtaaaagttttattgggagaattggtcagacaatttttttataataattctcgtattaagtataacgactccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgagatatataaagaaataaatgtcgagctttgttaccaatggataccttccagttacattggaacctcatgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgtcgactcataaaaaagagaatagcggtaagtataaacacgaatactatggcaataattgcgaatgttttattcccttcgatatatttttgataatatgaaaaacatgtctctctcaaatcggacaaccatctcataaaatagttctcgcgcgctggagaggtagttgctgctcgtataatctccccagaataatatacttctgtgtcatcgttcaatttatacggatttctatagttctctgttatataatgcggtttgccctcatgattagacaacgacaatagtgttctgaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggcggatctaatggaatccaattgattaactatcttttgaaaatatacatttttatgatccaatacttgtaagaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatatgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcaaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtttagaaagaaacgattatttctgaattattccaattatttgtccaaacaggaaagaagtatactatcgtcatttttttctctatatccagctactgctgataatgatagaatagacgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctctaacgagtgatcaaatcattgatacatttaaaagtaatcatgaaatcaaggatctaatatttttagatccgaattcaggtaatggactacaatacgaaattgcaaaatatgctctagatactgcaaaacttaaatgttacggccatagaggatgttattacgaatcattaaaaaaattaactgaggatgattgattagaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatatacgaacatagtcctcctagtttggagactaattctttttcatcgactagacgtttattctcaaatagtgattggtgttgtaaggatcctggtcgtagtaagttaaccaacatggtgaattcttgcacactattgacgataggtgtagccgataaacaaatcatcttatggttttttaatgcgatggtcttggataaaaaattatatactgaacgagtaggacggatcttaccatcttctttgattaatgatttagaaatgaagttatgacattcatcaataatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccgacacccgtttcatggaacaataaaagagaatgcatactgtctaatcctaagaaaactcttgctacaaaatgttgataatccttgaggcgtactacgtctgttcccatcatttcaacaggcatattagtagttctgcgcaatgcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgcgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctagagacagattaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattagccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctcaacaatctcggcagactccggataaccagtcggtgggccatcactaacaataactagatcatccaacaatctactcacatatgcatctatataatctttttcatcttgtgagtaccctggatacgaaataaatttattatccgtatttccataataaggtttagtataaacagagagcgatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagaccgatacgtaattaatacatttatatccaacatatggtacgtaaccgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatataaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaagtttattgtatttataaccttttccttatcttcatagaatactaaaggcaacaaagaaatttttggttcttctctaagagctacgtgagacttaaccatagacgccaacgaatccctacatattttagaacagaaatacccaacttcaccacccttgaatgtctcaatactaataggtttaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacatactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacgtggaagtttgactttttttgtacctttgtacatttttgaaataccgactcgcaaaaaatacaatattcatatccttgttcagatactataccgttgtgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatatggttaccgtcctccgccaatatagtagttaaattatccgcacatgcagaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaactgcggactttaacctatacatgataccgtttagcatgatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatagcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgcgtggatgctacttcgtcgatggaaaccatacaatcctttttgataggctgttgagattgattatttcctgcacgtttaggtttggtacgttgatttctagcccctgcggatataaagtcatcgtctacaattttggataatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatatccaatcttattacttttggaatcgttcaaaacctttgactaattgtagaatttgatctattgccctacgcgtatactcccttgcatcatatacgttcgtcaccagatcgtttgtttcggcctgaagttggtgcatatctctttcaacattcgacatgagatccttaagggccatatcgtctagattttgttgagatgttgctcctggattttgttgtgctgttgtacatactgtaccaccagtaggtgtaggagtacatacagtggccacaataggaggttgaggaggtgtaaccgttggagtagtacaagaaatatttccatccgattgttgtgtacatgtagttgttggtaacgtctgagaaggttgggtagatggcggtgtcgtcgtcttttgatctttattaaatttagagataatatcctgaacagcattgctcggcgtcaacgctggaaggagtgaactcgccggcgcatcagtatctgcagacagccaatcaaaaagattagacatatcagatgatgtattagtttgttgtcgtggttttggtgtaggagcagtactactaggtagaagaataggagccgatgtaggtgtcggaaccggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatccttttcttcagaataatagattgacgactttggtgtagaggattctgccagcccctgtgagaacttgttaaagaagtccatttaaggctttaaaattgaattgcgattataagattaaatggcagacacagacgatattatcgactatgaatccgatgatctcactgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattctttcttgttatcagatatgaatttgataagactttgaacattattgatacccgtctgtttaattttttctacagatattttagttttggcagattctatcgtatctgtcaatagacatccaacatcgacattcgacgtcaattgtctataaatcaacgtataaattttagaaataacattagcgaattgttgtgcattgatgtcgttattctgaaacagtatgattttaggtagcattttcttaacaaagagaacgtatttattgttactcagttgaacagatgatatatccagattactaacgcatctgattccgtataccaaactttcagaagaaatggtgtacaattgtttgtattcattcaatgtctccttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacgatctccattatttttttggaatcggatacaatatcttcggtatcttgacgcaatctagtatacatagagttaagagaaattagagtttgtacattgagcaacatgtctctaaatgtggctacaaacttttcctttttcacatcatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcgtatagaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagtcgtttattatcttgttccatattagcagtcattccatcatttaagaaggcgtcaaagataatagggagaaatgacattttggattctgttacaactttaccaaaattaaggatatacggacttactatctttttttcaacgtcaatttgatgaacacacgatgaaaatgtacttcgatgagattgatcatgtagaaaacaacaagggatacaatatttccgcatatcatgaaatatattaagaaatcccaccttattatatttccccaaaggatccatgcacgtaaacattatgccgttatcattaataaagacttctttctcatcggatctgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcgtacgatccaaattccggaatagatgtatcgcacgctctagccacccagataaccaaaaagtcacacgctccaggatatacattgtataaaaagctatcgttttttagtagtgtttttttctgagtatatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggaaaatagcggttttatatcccgtagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcagaacttccaataaaattacttaaagatagaaatgaattatttacaaaattcatcaacgagttaaaaaagaccagttcattcaagataagcaaacgcgataaggatacgctactaaaatattttacttaggactggagttagaatttatagacgactcatttcgtttatcattgttactattattactattactatcattattagtgttggcattattagtattcttcttgtcatcttgttcagaaatatacagcaatgctatacctaatactaaatacattatcatgctcgcaatggctctaacaacgacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtaacaagatttttaaacaacaatgccattttacacgatgattgtctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatctccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttactcttggtctaatactgatgatagagatattattacttcccataatggatcttctagtagtcaccttaaagcccattgatgcaaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcccgtctcagaaagtcctatatgcatgatagatttatctttcctgggaaactctcgtatagtcatagatgaaatactcttcaaagtttctgaaataagattagtaacagtcttacctccgactactctaggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgtggtttctacctatgtctacaaattgcacgtttggaagcgtaactgttacgttcactgcagcattttgaggatttcgagtatgaagtacgatgttattgtttactggtatatctggaaagaattctaccagtctaggaataagagattgatatcgcatagaaatacaaaagttcataatctcatcatcgaagagcattttgttaccattgtaataaatatccactctgtcatatgtataaatgaagtactgttcaaacatgatgagatgtttatatgttggcatagtagtgagatcgacgtttggtaatggcaatgtattaagattaactccataatgtctagcagcatctgcgatgttataagcgtcgtcaaagcggggtcgatcttgtgctgttatatattgtctaacacctataagattatcaaaatcttgtctgcttaatacaccgttaacaatttttgccttgaattcttttattggtgcattaataacatccttatagaggatgttaaacaaataagtattatcaaagttaagatctgggtatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaataatagggttagtttccgaactaatgttaattggggtattaataatatctatatttccagcgttaagtgtaacattaaacagttttaattcacgtgacgtggtatcaattaaataattaatgcccaatttggatatagcagcctgaagctcatcttgtttagttacggatcctaatgagttattaagcaatatatcgaacggatgaacgaaggttgttttaagttggtcacatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacgtttcgtagagagttattgatatcggaacaacgtcaacaacgagaaaaaagatttaatattacagtatcgaaaaatgctgaagcaataatggaatctagatctatgataacttctatgccaacacaaacaccatccttgggagtagtttatgataaagataaaagaattcagatgttagaggatgaagtggttaatcttagaaatcaacgatctaatacaaaatcatctgataatttagataattttaccaaaatactatttggtaagactccgtacaaatcaacagaagttaataagcgtatagccatcgttaattatgcaaatttgaacgggtctcccttatcagtcgaggacttggatgtttgttcagaggatgaaatagatagaatctataaaacgattaaacaatatcacgaaagtagaaaacgaaaaattatcgtcactaacgtgattattattgtcataaacattatcgagcaggcattgctaaaactcggatttgaagaaatcaaaggactgagtaccgatatcacttcagaaattatcgatgtggagatcggagatgactgcgatgctgtagcatctaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtgggcatctttttagatggtttctttttcccagcattaactgattcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtttaggagcaccagaagtatttttggagcccttggatgttgatgtagaagaagacgaggattttgattttggtttacatgtaatacattttgaactctttgattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtatttcttggttctggaggaggcgaatttaaattcggacttggattcggattttgtgggttcttgatcttattatacagcgcatataggatggcgacggtaactgctacgcaaataccgatcaacaaaagaataccaatcatttattgacaataacttcactattgatcaagtatgcaatatatcatcttttcactaaataagtagtaataatgattcaacaatgtcgagatatatggacgataataacttagttcacggaaatatcgctatgattggtgtgaatgactccgctaactctgtggggcgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatgtccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgactctacctgatgaatcggacaatgtactgggccatgtagaataaattatcaacgaattatcgtctacgaacatttatatcatttgttttaattttaggacgcgaataaatggatataaaatagaaaataacagatattacaaccagtgttatggccgcgcccaaccaggtaggcagttttattttatcttttactacaggttctcctggatgatgtacgttaccaactgcagacgtagttctagtacaattagacgtaagttccgcttgggaattttttaacgctaaagagttaacgttaatcgtgcacccaacgtatttacatctagttctttgaacatcttgattataatataaccattttctatctctagattcgtcggtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcatcacaatgttctgtcttgtaattattattaaatatttttggacagtgtttggtatttgtcttagaacaacattttgccacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaatttgggtttaatttctcctggagacgtttcataataatacatataactttcttcggcaaacttaacagctctattatattcaggataattaaaacctaattccatatatttgtctcgtatatctgctattcctggtgctattttaattctattaagagtaacggctgcccccatttttaataatcgtcagtatttaaactgttaaatgttggtatatcaacatttaccttatttcccgcagtataaggtttgttgcaggtatactgttcaggaatggttacatttatacttcttctatagtcctgtctttcgatgttcatcacatatgcaaagaacagaataaacaaaataatgtaagaaataatattaaatatctgtgaattcgtaaatacattgattgccataataattacagcagctacaatacatacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggattttgtagaagttgaaccgggatcatcctttaagtttctgatacctaagggattttacgcctctccttccgtaaagacgagtctagtatttgaaacattaacaacgaccgataataaaatcactagtatcaatccaacaaatgcgccaaagttatatcctcttcaacgcaaagtcgtatctgaagtagtttctaatatgaggaaaatgatcgaatcaaaacgtcctctatacattactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaacagaatttattgtaacagtattattaatattgccaagttatccgatctaaaaaaaactatctatgcggtagatagtttttttgagccatattccacagacaatattagacatatggtaaaacgactagatggaccatctaataaatatcatatatataccgagaagttattatctgtagacgagcctagaaatcaacttattcttaataccctggtagaagaattcaagtcaggaactattaatcgcattttagttattactaaactacgtgaacatatggtattattctacaaacgattattagatcttttcggaccagaggttgtatttataggagacgcccaaaatagacgtactccagatatggtcaaatcaatcaaggaactaaatagatttatattcgtatccaccttattttattccggtactggtttagatattcctagtttggattctttgttcatttgctcggcagtaatcaacaatatgcaaatagagcaattactagggaggatatgtcgagaaacagaactattagataggacggtatatgtatttcctagcacatccatcaaagaaataaagtacatgataggaaatttcgttcaacgaattattagtctgtctgtagataaactaggatttaaacaaaaaagttatcggaaacatcaagaatccgatcccacttctgcatgtacaacatcatccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcgactcttcattccggaacgcacattggtgctatccatttaggtagtaaaaaataagtcagaatatgccctatagcacgatcgtgcaaaacctggtatatcgtctctatctttatcacaatatagtgtatcgacatttttattattattgacctcgtttatcttggaacatggaatggaaacatttttgttatcaacggccacctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgagattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagataatatgcgaagtgcgtgtaacaaagtattagatagtgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctcttttgatgataaatttccaaaaatatccatatcgtatattaagttgggagaacttaggcggcaagttgtagactttttcaaattctcattcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatggaaactttaaccagttcgtctcaatctttaatgtcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcatgccattaagaaactagtgtattgcgacatccaacttactaaacacattattaatcagaatacgtatccggtatttaacgattcttcacaagtgaaatgttgtcattatttcgatataaactcagataatagcaatattagctctcgtacagtagagatatttgagagggaaaagtcatctcttgtatcatatattaaaactaccaataagaagagaaaggtcaattatggggaaataaagaaaactgtacatggaggcactaatgcaaattacttttccggtaaaaagtctgatgagtatctgagcactacagtcaggtccaacattaatcaaccttggatcaaaaccatttctaagagaatgagagtagatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaagatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaacactgattcagaaatggatcaacgactagggtataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgattaacgagttcaaatatgaaatgctgcataactttttacctcatatgaactatacacccgatcaactaaagggattttatatgatatctttactaagaaagtttctctactgtatctaccacacttctagatatccagatagagattcgatggtttgtcatcgtatactaacatacggcaaatattttgagacgttggcacatgatgaattagagaattacataggcaacatccgaaacgatatcatgaacaatcacaagaacagaggcacttacgcggtaaacattcatgtactaacaactcctggacttaatcatgcgttttctagcttattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcggacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgatatgacattctctgacattcagaaagagtttccacatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtagcatcttcactagtgggaatcaatcacaattctggacccagagctattcttggatgtgctcaagctaaacaagctatctcttgtctgagttcggatatacgaaataaaatagacaatggaattcatttgatgtatccagagaggccaattgtcattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatatagttaccgcaaagaaacatcaagtagaaattccgttggaaaactttaataacaaagaaagagataggtctaacgcctattcaaaattagaaagtaatggattagttagactgaatgctttcttggaatccggagacgctatggcacgaaatatctcatcaagaactcttgaagatgattttgctagagataatcagattagcttcgatgtttccgagaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatgtcgcggatgaaacggaacttccatacgacgaaaatggtatcacaccagatgtcattattaattctacatccatcttctctagaaaaactatatctatgttgatagaagttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtctgatgaagaattatcggataaaatcttttgtgaaaagattctctatgatcctgaaacggataagccttatgcatccaaagtattttttggaccaatttattacttgcgtctgagacatttaactcaggacaaggcaaccgttagatgtagaggtaaaaagacgaagctcattagacaagcgaatgagggacgaaaacgtggaggaggtattaagtttggagaaatggagagagactgtttaatagcgcatggcgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagttaaattagatttcgaacgaaggcctccttcgttttataaaccattagataaagttgatctcaagccgtcttttctggtgtaatattctagtttggtagtagatacatatcaatatcatcaaattcgagatccgaattataaaatgggcgtggattgttaactatagaatcggacgtctgatattcgaaaatctgtggagtttcaggttttggtggaggtgtaactgctacttgggatactgaagtctgatattcagaaagctgggggatgttctggttcgacatccaccgatggtgtcacatcactaatcggttcggtaacgtctgtggatggaggtgctacttctacagaacctgtagcctcagttgtcaacggagatacatttttaatgcgaggaaatgtataatttggtaatggtttctcatgtggatctgaagaagaggtaagatatctactagaaagataccgatcacgttctagttctcttttgtagaacttaactttttctttctcagcatctagttgatattccaacctcttcacgttactacgttcagatttcaattcacgttcgcatgggttacctccgcagtttttacgagcgatttcacgttcagccttcatgcgtctttccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcgaaatatcgttccagctccttttcgacatcaataactttagcacgttgtctctcaagctctcttttgtagttatctgattccctggcacgtttaagatcttcatgcaattgagtcagctcttaacacaatctcttgcttcttcgtcatagtacttacaatcactatgggatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgccgaatagagttctgattcatcctttgagcagatctctagagatcgttcaagatccctgattctagtctttagcctatttacctcctcggaagatgctccgttaccgttgcgtttacactcgttaagctgtctatcaagatccatgattctatctctaagacgttgcatctctctttccatatcagcattgctttcattattacgtctgcagtcactcaactgtctttcaatatctgagattctatctctaagacgtcgcatctctctctgtttcggcattggtttcattattacgtctacagtcgttcaactgtctttcaagatctgatattctagattggagtctgctaatctctgtagcattttcacggcattcactcagttgtctttcaagatctgagattttagattggagtctgctaatctctgtaagatttcctcctccgctctcgatgcagtcggtcaacttattctctagttctctaatacgcgaacgcagtgcatcaacttcttgcgtgtcttcctggttgcgtgtacattcatcgagatctctaacgcgtcgtcgttcttcctcaagttctctgcgtactacagaaagcgtgtccctatcttgttgatatttagcaatttctgattctagagtactgattttgcttacgtagttactaatatttgtcttggccttatcaagatcctccttgtatttgtcgcattccttgatatccctacgaagtctggacagttcccattcgacattacgacgtttatcgatttcagctcggagatcgtcatcgcgttgttttagccacatacgactgagttcaagttctcgttgacaagatccatctacttttccattcctaatagtatccagttccttttctagttctgaacgcatttctcgttccctatcaagcgattctctcaattctcggatagtcttcttatcaatttctaataaatctgaaccatcatctgtcccattttgaatatccctgtgttctttgatctcttttgtaagtcggtcgattctttcggttttataaacagaatccctttccaaagtcctaatcttactgagtttatcactaagttctgcattcaattcggtgagttttctcttggcttcttccaactctgttttaaactctccactatttccgcattcttcctcgcatttatctaaccattcaattagtttattaataactagttggtaatcagcgattcctatagccgttcttgtaattgtgggaacataattaggatcttctaatggattgtatggcttgatagcatcatctttatcattattagggggatggacaaccttaattggttggtcctcatctcctccagtagcgtgtggttcttcaataccagtgttagtaataggcttaggcaaatgcttgtcgtacgcgggcacttcctcatccatcaagtatttataatcgggttctacttcagaatattcttttctaagagacgcgacttcgggagttagtagaagaactctgtttctgtatctatcaacgctggaatcaatactcaagttaaggatagcgaatacctcatcgtcatcatccgtatcttctgaaacaccatcatatgacatttcatgaagtctaacgtattgataaacagaatcagatttagtattaaacagatccttaacctttttagtaaacgcatatgtatattttagatctccagatttcataatatgatcacatgccttaaatgtcagtgcttccatgatataatctggaacactaatgggtgacgaaaaagatacagcaccatatgctacgttgataaataaatctgaaccactaagtagataatgattaatgttaaggaaaagaaaatattcagtgtataggtatgtcttggcgtcatatcttgtactaaacacgctaaacagtttattgatgtgatcaatttccaacagaataattagagcagcaggaataccaacaaacatattaccacatccgtattttctatgaatatcacatatcatgttaaaaaatcttgatagaagagcgaatatctcgtctgacttaatgagtcgtagttcagcagcaacataagtcataactgtaaatagaacatactttcctgtagtgttgattctagactccacatcaacaccattattaaaaatagttttatatacatctttaatctgctctccgttaatcgtcgaacgttctagtatacggaaacactttgatttcttatctgtagttaatgacttagtgatatcacgaagaatattacgaattacatttcttgtttttcttgagagacctgattcagaactcaactcatcgttccatagtttttctacctcagtggcgaaatctttggagtgcttggtacatttttcaataaggttcgtgacctccatttattataaaaaattttattcaaaacttaactacaatcgggtaattataaaatcgtagatctcccatgtggtggaatactaccatctatcgcatgtggatggacagtaggtaatggccatgggaacagtaatgtttgcatatttatctttcttgccagtattactgcatattgtcccaatgtttcgatgtgatgttctaacctatcaactgccgctgtatcacaacaatagtgtccgatgaaattaagattatgatccaatgtgtttaatatatgattatcaagtcttatacgatccgcgtcttttttgacaggatcaggttcttctacaggaagaagtttcggcctcttatgatattcatgtctgggaaacggtggtctagggtgaggctccggtatcggagtgggttttggattataatcatcatcgtctatgacatcatcttcgacttcgatatttattttgctatcttgatgatgtcctgtatcagttgcattttcagcactcgactgaatattagcgcattcattgtctattattaccatatttctaaatccaaaatgtatatgttgaacatcactactatcgttgatgagtcttatagcatgaattcgcttatcgttatcgggtttagcttctgtcaccttagcaattccttttttattaaactctacataatcatatccatttctattgtttgttctaatataaacgagtatagcatcattgctaaatttttcaatagtatcgaaaacagaatatcctaaaccatataatatatattcaggaacactcaaactaaatgtccaggattctcctaaatacgtaaactttaatagtgcgaaatcattcaaaaatctaccacttatagatagatagtacataaatgcgtatagtagtctacctatctctttattatgaaaaccggcattacgatcatatatatcatgatatacctgtgacccgtttacgttaaaccataaatacatgggtgatcctataaacatgaatttatttctaattctcagagctatagttaattgaccgtgtaatatttgcttacatgcatacttgatacgctcattaataagatttttatcattgctcgttatctcagaatcgtatatataaggagtaccatcgtgattcttaccagatattatacaaaatactatatataaaatatattgaccaacgttagtaatcatataaatgtttaacgttttaaattttgtattcaatgatccattatcatacgctagcatggtcttatgatattcattctttaaaatataatattgtgttagccattgcattggggctcctaatggagattttttattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatggacgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagcctttgtagaaaaaaattcagttgctggaattgcaagatcgtcatctccggggaaaagagttccgtccatttaaagtacagattttagaaactgacactctgcgttatttatatttggtacaacacatggattataaatatcgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtcgctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagagataactataaatggagatctagatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgggatcttttcaaatagactaaaaaccccatttctctagtaagtatcttatgtatatgtttgtaaaatatcttcatggtgggaatatgctctaccgcagttatccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtatcttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaatgatctaaagatgatgctattttacatggatttatcatatcatggagtgacaagtagtggagcaatttacaaattgggatcgtctatcgatagactttctctaaataggactattgttacaaaagttaataattatgatgatacattttttgacgacgatgattgatcgctattgcacaattttgtttttgtactttctaatatagtgtttaggttctttttcatatgagaatattgatttactaaaatatctatgtttaacttttgttctataacgtccttatcggcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgagatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagcttcctgactactaacgaaattaatatgatttggccaaatgtatccatcataatctgggttataaacgggtgtaaacaagaatatatgtttatattttttaactagtgtagaaaacagagatagtaaatagatagtttttccagatccagatcctcccgttaaaaccattctaaacggcatttttaataaattttctcttgaaaattgtttttcttggaaacaattcataattatatttacagttactaaattaatttgataataaatcaaaatatggaaaactaaggtcgttagtagggaggagaacaaagaaggcacatcgtgacataaataacatttattatcatgatgacaccagaaaacgacgaagagcagacatctgtgttctccgctactgtttacggagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacacaatatgatcacaaagaaagctgtaatggtttatattaccagggttcttgttatatattacattcagactaccagttattctcggatgctaaagcaaattgcactgcggaatcatcaacactacccaataaatccgatgtcttgattacctggctcattgattatgttgaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagccagattgcctagaccggatactagacatctgagagtattgtttagtattttttataaagattattgggtaagtttaaaaaagaccaataataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggattataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtaattaatgaaacggagactgttaaagtacttaatgaagataccaaacagaatcctaactattcatccaatcctttcgtaaattataataaaaccagtatttgtagcaagtcaaatccgtttattacagaacttaacaataaatttagtgagaataatccgtttagacgagcacatagcgatgattatcttaataagcaagaacaagatcatgaacacgatgatatagaatcatcggtcgtatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacgtcaatggcaaaaatattctaacctttcccattgatcatgctgtaatcatatccccactgagtaaatgtgtcgtagttagcaagggtcctacaaccatattggttgttaaagcggatatacccagcaaacgattggtaacatcgtttacaaacgacatactatatgtaaacaatctgtcactgattaattatttgccgttgtctgtattcattattagacgagttaccgactatttggatagacacatatgcgatcagatatttgcgaataataagtggtattccattataaccatcgacaataagcagtttcctattccatcaaactgtataggtatgtcctctgccaagtacataaattctagcatcgagcaagatactttaatacatgtttgtaacctcgagcatccattcgacttagtatacaaaaaaatgcagtcgtacaattctgtacctatcaaggaacaaatattgtacggtagaattgataatataaatatgagcattagtatttctgtgtattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgataaaaagaataagaataagatcaaggattatatggaacacgattattataaaataacaatagttcctggttcctcttccacgtctactagctcgtggtattatacacatgcctagtaatagtctctttgcgttgatggaaagcagactagaaataacaggctaaaatgttcagacaccataatagttcccaacccagataataacagagttccatcaacacattcctttaaactcaatcccaaacccaaaaccgttaaaatgtatccggccaattgatagtagataatgaggtgtacagcacatgataatttacacagtaaccaaaatgaaaacactttagtaattataagaaatatagacggtaatgtcatcatcaacaatccgataatatgcctgagagtaaacattgacggataaaacaaaaatgctccgcataactctatcatggcaataacacaaccaaatacttgtaagattcctaaattagtagaaaatacaacggatatcgatgtataagtgatctcgagaaataataagaataaagtaatgcccgtaaagataaacatcaacattgtttggtaatcattaaaccaattagtatgaagttgaactaatttcacagtagattttattccagtattatccccgcatgtatacgtacctggtaagatatctttatattctataatcaatgagacatcactatccgataacgaatgaagtctagcactagtatgccatttacttaatatggtcgtcttggaagttttattataagttaaaatatcatggttatccaatttccatctaatatactttgtcggattatctatagtacacggaataatgatggtatcattacatgctgtatactctatggtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatataacaacatctataaaagtagaggatgcggataaggatacattagtatgcggaaccaataacggaaatcccaaatgttggaaaatagacggttcagacgacccaaaacatagaggtagaggatacgctccttatagcaaagtaacgataatcagttacaacgaatgtgtactatctgacataaacatatcaaaagaaggaattaaacgatagagaagatttgacggaccatgtggttatgatttattcacggcggataacgtaattccaaaagatggtttacgaggagcattcgtcgataaagacggtacttatgacaaagtttacattcttttcactgatactatcggctcaaagagaattgttaaaattccgtatataacacaaatgtgcttaaacgacgaaggtggtccatcatcgttgtctagtcatagatggtcgacgtttctcaaagtcgaattagaatgtgacatcgacggaagaagttatagataaattattcattctaaaactataaaaacagataatgatacgatactatatgtattcttcgatagtccgcattatgtacctattctatgaataccattaaacaatctttttctacgtcaaaattggaaggatatacaaagcaattgccgtctccagctcctggtatatgtctaccagctggaaaagttgttccacataccacgtttgaagtcatagaaaaatataatgtactagatgatattataaagcctttatctaaccaacctatcttcgaaggaccgtctggcgttaaatggttcgatataaaggagaaggaaaatgaacatcgggaatatagaatatacttcataaaagaaaattctatatattcattcgatacaaaaactaaacaaactcgcagtgcacaagtcaatgcacaactattttcagtaatggtaactgcgaaaccgttatttatagcagatatagggataggagtaggaatgccacaaatgaaaaaaatacttaaaatgtaatcttaatcgagtacaccacacgacaatgaacaaacataagacagattatgctggttatgcttgctgcgtaatatgcggtctaattgttggaattatttttacagcgacactattaaaagttgtagaacgtaaattagttcatacaccatcaatagataaaacgataaaagatgcatatattagagaagattgtcctactgactggataagctataataataaatgtatccatttatctactgatcgaaaaacctgggaggaaggacgtaatacatgcaaagctctaaatccaaattcggatctaattaagatagagactccaaacgagttaagttttttaagaagcattagacgcggatattgggtaggagaatccgaaatattaaaccagacaaccccatataattttatagctaagaatgccacgaagaatggaaatatatttgtagtacaacgaatactcccaaactgcattcgtgttacactatataacaattacactacatttttatcataccactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccgcactcatcgtatattttgacgtatgcagtcacatcgtttacgcaatagtcagactgtagttctatcatgcttcctacatcagaaggaggaacagttttaaagtctcttggttttaatctattgccattagttttcatgaaatcctttgttttatccacttcacattttaaataaatgtccactatacattcttttgttaattttactagatcgtcatgggtcatagaatttataggttccgtagtccatggatccaaactagcaaacttcgcgtatacggtatcgcgattagtgtatacaccaactgtatgaaaattaagaaaacagtttaataaatcaacagaaatatttaatcctccgtttgatacagatgcaccatatttatggatttcggattcacacgttgtttgtctgaggtgttcgtctagtgttgcttctacataaacttcgattcccatatattctttattgtcagaatcgcataccgatttatcatcatacactgtttgaaaactaaatggtatacacatcaaaataataaataataacgagtacattctgcaatattgttatcgtaattggaaaaatagtgttcgagtgagttggattatgtgagtattggattgtatattttattttatattttgtaataagaatagaatgctaatgtcaagtttattccaatagatgtcttattaaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatccgggtgaaattattcctctcatcactaatcgtaatattctaaaacctcttattggtcagaaatattgtattgtatatactaactctctaatggacgagaacacgtatgctatggagttgcttactgggtacgcccctgtatctccgatcgttatagcgagaactcataccgcacttatatttttgatgggtaagccaacaacatccagacgtgacgtgtatagaacgtgtagagatcacgctacccgtgtacgtgcaactggtaattaaaataaaaagtaatattcatatgtagtgtcaattttaaatgatgatgatgaaatggataatatccatattgacgatgtcaataatgccggtattggcatacagctcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccaagtgtattattataataggatatgattctattatatggtataaagatataaatgacaagtataatggcatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgttacaccaaaaaagaaaaggatgtattattagcgcaatcagttgctgtcgaagaggcaaaagatgtcaaggtagaagaaaaaaatattatcgatattgaagatgacgatgatatggatgtagaaagcgcataatacgatctataaaaataagtatataaatactttttatttactgtactcttactgtgtagtggtgataccctactcgattatttttttaaaaaaaaaatacttattctgattcttctaaccatttccgtgttcgttcgaatgccacatcgacgtcaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaatcctagatccttgttctattcccaatggtttcatcaatagaagattaaacatatcgtacgaacacgatggagagtaatcgtagcaaaagtaagcatttcctttaatcttagatcccggatactggatatattttgcagccaacacgtgcatccatgcagcatttcctacatatacccggctatgtaccgcgttatcatcgactgtacgatacataatgttaccgtgttgcttacattgctcgtaaaagactttcgtcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaaaatagtctgtgttccataatagtttactttcatgatttcattatcggtgtattttccaaatacatccactagagcagctgtatgaataatcagatttaccccatttagcgcttctctcaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccacttataatatcaaactacttattctattttactaaataatggctgtttgtataataaaccacgataatatcagaggagttatttactttgaaccagttcatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatttacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgactccatagagataagaggggtgcttccagaggaaactaatattggttgcgcggttaatacgccggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaagtataggtgtatggcattagccgaacatatatctgatagtattccaatatctgagctatctagactacgatacaatctatgtaagtatctacgcgggcacactgagagcatagaggataaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaaaaaaattatactgtaacacaataaaggagtcttatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggagtattccaagagttttagttgtctagtatttaacaagagaagagatttcaacagactgtttatgaactcgaatgccgcctcattgtcgcttatattgatgatgtcgaattctcccaatatcatcaccgatgagtagctcatcttgttatcgggatccaagttttctaaagatgtcattaaaccctcgatcatgaatggatttatcatcatcgtttttatgttggacatgagcttagtccgtttgtccacatctatagaagatgatttctgaattatttcatatatctctctctttaactccaggaacttgtcaggatggtctactttaatatgttctcgtctaagagatgaaaatctttggatggttgcacgcgacttttctctaaaggatgacgttgcccaagatcctctcttaaatgaatccatcttatccttggacaagatggacagtctattttccttagatggtttaatatttttgttacccatgatctataaaggtagacctaatcgtctcggatgaccatatatttattttcagttttattatacgcataaattgtaaaaaatatgttaggtttacgaaaatgtctcgtggggcattaatcgtttttgaaggattggacaaatctggaaaaacaacacaatgtatgaacatcatggaatctataccggcaaacacgataaaatatcttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattctctggagtagcgtatgccgccgctaaaggcgcgtcaatgactctcagtaagagttatgaatctggattgcctaaacccgacttagttatattcttggaatctggtagcaaagaaattaatagaaacgtcggcgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatagatgttagtacagtgttataaatggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagatctatcagaccgaattgattaattcattagacgacaatgaaattatcgattgtatagttaataagtttatgagcttttataaggataacctagaaaatatagtagatgctatcattactctaaaatatataatgaataatccagattttaaaactacgtatgcagaagtactcggttccagaatagcggatatagatattaaacaagtgatacgtgagaatatactacaattgtctaataatatccgcgaacgatatttgtgaaaatattaaaaaaaaatactttttttattaaatgacgtcttttcgtgaatttagaaaattatgctgtgctatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattagtacattcttcaaagaaaacacagaaatccgtccaagagataaaagcattttaactttagaagacgtggatagtttcttaactacgttatcatccgtaactaaagaattgcatcaaataaaattattgactgatgtagcatctgtttgtacatgtaatgatttaaaatgtgtagtcatgcttattgataaagatctaaaaattaaagcgggccctcggtacgtacttaacgctattagtcctcatgcctatgatgtttttagaaaatctaataacttgaaagagataatagaaaatgcatctaaacaaaatctagactctatatctatttctgttatgactccaattaatcccatgttagcggaatcgtgtgattctgtcaataaggcgtttaaaaaatttccatcaggaatgtttgcggaagttaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggtatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcttactatggtaaaggagcaaagggtggtatcatggcagtctttctaatgggttgttacgacgataaatccggtaaatggaagacggttaccaagtgttcaggacacgatgataatacgttaagggagttgcaagaccaattaaagatgattaaaattaacaaggatcccaaaaaaattccagagtggttggtagttaataaaatctatattcccgattttgtagtagaggatccaaaacaatctcagatatgggaaatttcaggagcagagtttacatcttccaagtcacatacagcgaatggaatatcgattagatttcctagatttactaggataagagaggataaaacgtggaaagaatctactcatctaaacgatttagtaaacttgactaaatcttaatagttacatacaaactgaaaattaaaataacaccatttagttggtggtcgccatggatggtgttattgtatactgtctaaacgcgttagtaaaacatggcgaggaaataaatcatataaaaaatgatttcatgattaaaccatgttgtgaaaaagttaagaacgttcacatcgacggacaatctaaaaacaatacagtgattgcagatttgccatatctggataatgctgtatcggatgtatgcaaatcgatatatatatagtatcaagaatatccagatttgctaatttgataaagatagatgacgatgacaagactcctactggtgtatataattattttaaacctaaagatgccattcctgttattatatccataggaaaggatagagatgtttgtgaactattaatctcatctgataaagcgtgtgcgtgtatagagttaaattcatataaagtagccattcttcccatggatgtttccttttttaccaaaggaaatgcatcattgattattctcctgtttgatttctctatcgatgcggcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcgatagctgataatagaacttacgcaaatattagcaaaaatatattagacaatactacaattaacgatgagtgtagatgctgttattttgaaccacagattaggattcttgatagagatgagatgctcaatggatcatcgtgtgatatgaacagacattgtattatgatgaatttacctgatgtaggcaaatttggatctagtatgttggggaaatatgaacctgacatgattaagattgctcttttggtggctggtaatttaataagaaatcgagactacattcccgggagacgaggatatagctactacgtttacggtatagcctctagataatttttttaagcacgaaataaaaaacataattttaaaccaatctatttcatactattttgtgtgatcaccatggacataaagatagatattagtatttttggtgataaatttacggtgactactaggagggaaaatgaagaaaaaaaaaaatatctacctctccaaaaagaaaaaactactgatgttatcaaacctgattatcttgagtacgatgacttgttagatagagatgagatgtttactattctagaggaatattttatgtacagaggtctattaggcctcagaataaaatatggacgactctttaacgaaattaaaaaattcgacaatgatgcggaagaacaattcggtactatagaagaactcaagcagaaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagcgattaaactgtttattaatgatcacatgcttgataagataaaatctatactgcagaatagactagtgtatgtggaaatgtcatagaaagttaaaagttaatgagagcaaaaatatataaggttgtattccatatttgttattttttctgtaatagttaaaaaatacattcgatggtctatctatcagattattatgtgttataaggtactttttctcataataaactagagtatgagtaagatagtgtttttcaaaacatataaatctaaaattgatggatgagatatacagctattaatttcgaaaatatattttaatctgataactttaaacatggatttttgatggtggtttaaagtttaaaaaaaagattttgttattgtagtatatgataatatcaaaaagatggatataaagaatttgctgactgtatgtactattttttacattactacattggctacggcagatatacctacttcgtcactgccacacgctccggtaaacggggcatgtgacgagggagaatatcttgataagaggcataatcaatgttgtaatcagtgtccacctggagaatttgccaaggtcagatgtagtggtagtgataacacaaaatgtgaacgctgcccacctcatacatataccgcaatccccaattactctaatggatgtcatcaatgtagaaaatgcccaacaggatcatttgataaggtaaagtgtaccggaacacagaacagtaaatgttcgtgtcttcctggttggtattgcgctactgattcttcacagactgaagattgttgaaattgtgtaccaaaaaggagatgtccatgcggatactttggtggaatagatgaacaaggaaatcctatttgtaaatcgtgctgtattggtgaatattgcaactacctacgtaattatagacttgatccattttctccatgcaaactatctaaatgtaattaattatgattttgatgataatgttaccatacattatatcgctacttggttagtgtattattcagtatgaagacctattaataattacttatcttttgacgatcttgttataattataatataaaaacttatggcatagtaacttataattgctaacacgataaattcgtaataatctgttttgttcaaatttttataaggaatctacaggcataaaaataaaaatataatttataatatactcttacaacgccatcatgaatagcagcagtaaattaattgctgttattaatggatttagaaatagtggacgattttgtgatattaatatagttattaatgatgaaaggataaacgctcataaactcatcctatctggagcctccgaatatttttccattctgttttccaataattttatcgattctaatgaatacgaagttaatctaagtcatttagattatcaaagcgtaaacgatttgatcgattatatttatgggatacctttgagcctaactaacgataacgtgaaatatattctttcaaccgctgattttttacaaattggatctgctattacggagtgtgaaaattacatacttaaaaatctttgttctaaaaactgtatcgatttctacatatacgctgataaatataataacaagaaaatagaatcagcgtcgtttaacacaatattacaaaatattttgagactcatcaacgatgaaaactttaaatacttaacagaggaatcaatgataaaaattttaagcgatgatatgttaaatataaaaaatgaggatttcgccccactaattctcattaaatggttagagagtactcaacaatcatgcaccgtcgagttacttaaatgcctcagaatatcattgctttccccacaagttataaaatcactttatagtcatcaactggttagttcaatctacgaatgtataacattcttaaacaatatagcattcttggatgaatcatttcctagataccatagcatcgagttgatatctatcggtataagtaattcgcgtgataaaatttccataaactgctacaatcataaaaaaaatacatgggaaatgatatcttcacgtagatataggtgtagtttcgcagtggccgtcctggataatattatctatatgatgggtggatatgatcagtccccgtatagaagttcaaaggttatagcgtacaatacatgtacaaattcttggatatatgatataccagagctaaaatatcctcgttctaattgtgggggactggctgatgacgaatacatttattgtataggcggcatacgcgatcaggattcatcgttgacatctagtattgatagatggaagccatcaaaaccatattggcagaagtatgctaaaatgcgcgaaccaaaatgtgatatgggggttgcgatgttaaacggattaatatatgtcatgggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatctagtccttagctataattcgatatatgatgaatggaccaaattatcatcattaaatattcctagaattaatcccgctctatggtcagcgcataataaattatatgtaggaggaggaatatctgatgatgttcaaactaatacatctgaaacatacgataaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattctattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcaactacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatcgcgactccggaaccaattactgataatgtagaagatcatacagacaccgtcacatacactagtgatagcattaatacagtaagtgcaacatctggagaatccacaacagacgagactccggaaccaattactgataaagaagatcatacagttacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcatattgagcggaccatctggttcaggaaagacagccatagccaaaagactatgggaatatatttggatttgtggtgtcccataccactagatttcctcgtcctatggaacgagaaggtgtcgattaccattacgttaacagagaggccatctggaagggaatagccgccggaaactttctagaacatactgagtttttaggaaatatttacggaacttctaaaacagctgtgaatacagcggctattaataatcgtatttgtgtgatggatctaaacatcgatggcgttagaagtcttaaaaatacgtacctaatgccttactcggtgtatataagacctacctctcttaaaatggttgagaccaagcttcgttgtagaaacactgaagctaacgatgagattcatcgtcgcgtgatattggcaaaaacggatatggatgaggccaacgaagcaggtctattcgacactattattattgaagatgatgtgaatttagcatatagtaagttaattcagatactacaggaccgtattagaatgtattttaacactaattaaagacttaagacttaaaacttgataattaataatataactcgtttttatatgtgtctatttcaacgtctaatgtattagttaaatattaaaacttaccacgtaaaacttaaaatttaaaatggtatttcattgacagatagatcacacattatgaactttcaaggacttgtgttaactgacaattgcaaaaatcaatgggtcgttggaccattaataggaaaaggtggatttggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagattaccaaaaaggtcggtgatgttgatcggaatcgaaatcttaaataccatacaatttatgcacgagcaaggatattctcacggagatattaaagcgagtaatatagtcttagatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttgccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattacgacgagtttcggcacatattaatgcagggtgtatattattaagtgtggtgtttggtcgatgtaaaatttttgtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcaggaaatattctgttgtgtcagtttataataacaagtatgacattgtaaaagacaaatatatgtggtgttacagtcaggtgaacaagagatatattggagcactgctgcctatgtttgagtgcaatgaatatctacaaattggagatccgatccatgatcaagaaggaaatcaaatctctatcatcacatatcgccacaaaaactactatgctctaagcggaatcgggtacgagagtctagacttgtgtttggaaggagtagggattcatcatcacgtacttgaagcaggaaacgctgtatatggaaaagttcaacatgattattctactatcaaagagaaggccaaagaaatgagtacacttagtccaggacctataattgattaccacgtctggataggagattgtatctgtcaagttactgctgtggacgtacatggaaaggaaattatgaaaatgagattcaaaaagggtgcggtgcttccgatcccaaatctggtaaaagttaaacttggggagaatgatacagaaaatctttcttctactatatcggcggcaccatcgaggtaaccacctctctggaagacagcgtgaataatgtactcatgaaacgtttggaaactatacgccatatgtggtctgttgtatatgatcattttaatattgtgaatggtaaagaatgctgttatgtgcatacgcatttgtctaatcaaaatcttataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaatcaattgagagattggcagaggagttcttcaatagatcagaacttcaggctggtaaatcagttaaatttggtaattctattaattgttaaacatatacatctgtttcagctaagcaactaagaacacgtatacggcagcagcttccttctatactctcatcttttaccaagggtggatatttgttcattggagttgataataatacacacaaagtaattggattcacggtgggttacgactacctcagactggtagagaatgatatagaaaagcatatcaaaagactttgtgttgtgtatttctgtgagaagaaagaggacatcaagtacacgtgtcgattcatcaaggtatataaacctggggatgagactacctcgacatacgtgtgcgctatcaaagtggaaagatgctgttgtgctgtgtttgcagattggccagaatcatggtatatggatactaatggtatcaataagtattctccagatgaatgggtgtcacatataaaattttaattaatgtaatagagaacaaataataaggttgtaatatcatatagacaataactaacaattaattagtaactgttatctcttttttaactaaccaactaactatatacctattaatacatcgtaattatagttcttaacatctattaatcattaattcgcttctttaattttttataaactaacattgttaattgaaaagggataacatgttacagaatataaattatatatggatttttttaaaaaggaaatacttgactggagtatatatttatctcttcattatatagcacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcgggttatcatcatccattaatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgccgaagacagttacggttgtacattattacatagatgtatatatcactataagaaatcagaatcagaatcatacaatgaattaattaagatattgttaaataatggatccgatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacagaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaacataaacagcataatgcagatttattgaaaatgtgtataaaatatactgcgtgtatgaccgattatgatactcttatagatgtacagtcgctacagcaatataaatggtatattttaagatgtttcgatgaaatagatatcatgaagagatgttatataaaaaataaaactgtattccaattagttttttgtatcaaagacattaatactttaatgagatacggtaaacatccttctttcgtgaaatgcactagtctcgacgtatacggaagtcgtgtacgtaatatcatagcatctattagatatcgtcagagattaattagtctattatccaagaagctggatgcgggagataaatggtcgtgttttcctaacgaaataaaatataaaatattggaaaactttaacgataacgaactgtccacatatctaaaaatcttataaacattattaaaatataaaatctaagtaggataaaatcacactacatcattgtttccttttagtgctcgacagtgtatactatttttaacactcataaataaaaatgaaaacgatttccgttgttacgttgttatgcgtactacctgctgttgtttattcaacatgtactgtacccactatgaataacgctaaattaacgtctaccgaaacatcgtttaataataaccagaaagttacatttacatgtgatcagggatatcattctttggatccaaatgctgtctgcgaaacagataaatggaaatacgaaaatccatgcaagaaaatgtgcacagtttctgattatgtctctgaactatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatataactatcaactgtgatgttggatatgaggttattggtgcttcgtacataagttgtacagctaattcttggaatgttattccatcatgtcaacaaaaatgtgatataccgtctctatctaatggattaatttccggatctacattttctatcggtggcgttatacatcttagttgtaaaagtggttttatactaacgggatctccatcatccacatgtatcgacggtaaatggaatcccatactcccaacatgtgtacgatctaacgaaaaatttgatccagtggatgatggtcccgacgatgagacagatttgagcaaactctcgaaagacgttgtacaatatgaacaagaaatagaatcgttagaagcaacttatcatataatcatagtggcgttaacaattatgggcgtcatatttttaatctccgttatagtattagtttgttcctgtgacaaaaataatgaccaatataagttccataaattgctaccgtaaatataaatccgttaaaataattaataattaataacgaacaagtatcaaaagattaaagaattatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatattactgtatgtgtgggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcagtagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacatgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattaactgaatacgacgaccatatcaatttgtacatcgagcatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcggaagtatgtctgacacctaaaaagagtgtatatacatgcgcaattagatccaaagaagatgttcccaatttcaaggacaaaatggccagagttatcaagagaaaatttaataaacagtctcaatcttatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttttatcccgaaagaactgattgcagtgttcatctcccaactgcaagtgaaggattgataactgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcatcgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattgattgaaaatgaaaatataaatagtttttatgtatagcagtattaccctatagttttattgcttactactaacatggatacagatgttacaaatgtagaagatatcataaatgaaatagatagagagaaagaagaaatactaaaaaatgtagaaattgaaaataataaaaacattaacaagaatcatcccaatgaatatattagagaagcactcgttattaataccagtagtaatagtgattccattgataaagaagttatagaatgtatctgtcacgatgtaggaatatagatcatatctactaatttttataatcgatacaaaacataaaaaacaactcgttattacatagcaggcatggaatccttcaagtattgttttgataacgatggcaagaaatggattatcggaaatactttatattctggtaattcaatactatataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaaaaattcgggaagagtattcgccccaaaggatactgaatcagtcttcgaagcatgtgtcactatgataaacacgttagagtttatacactctcgaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaaaacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtaaactgtttatacaagattgaaattatattctttttttatagagtgtggtagtgttacggatatctaatattaatattagactatctctatcgcgctacacgaccaatatcgattactatggatatcttcagggaaatcgcatcttctatgaaaggagagaatgtatttatttctccagcgtcaatctcgtcagtattgacaatactgtattatggagctaatggatccactgctgaacagctatcaaaatatgtagaaacggaggagaacacggataaggttagcgctcagaatatctcattcaaatccatgaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaaccattgtctcctagcaattagtgccgtatactttaaagcaaaatggttgacgccattcgaaaaggaatttaccagtgattatcccttttacgtatctccgacggaaatggtagatgtaagtatgatgtctatgtacggcaaggcatttaatcacgcatctgtaaaggaatcattcggcaacttttcaatcatagaactgccatatgttggagatactagtatgatggtcattcttccagacaagattgatggattagaatccatagaacaaaatctaacagatacaaattttaagaaatggtgtgactttatggatgctatgtttatagatgttcacattcccaagtttaaggtaacaggctcgtataatctggtggatactctagtaaagtcaggactgacagaggtgttcggttcaactggagattatagcaatatgtgtaattcagatgtgagtgtcgacgctatgatccacaaaacgtatatagatgtcaatgaagagtatacagaagcagctgcagcaacttgtgcactggtgtcagactgtgcatcaacaattacaaatgagttctgtgtagatcatccgttcatctatgtgattaggcatgttgatggcaaaattcttttcgttggtagatattgctctccaacaactaattgttaaccattttttttaaaaaaatagaaaaaacatgtggtattagtgcaggtcgttattcttccaattgcaattggtaagatgacggccaactttagtacccacgtcttttcaccacagcactgtggatgtgacagactgaccagtattgatgacgtcaaacaatgtttgactgaatatatttattggtcgtcctatgcataccgcaacaggcaatgcgctggacagttgtattccacactcctctcttttagagatgatgcggaattagtgttcatcgacattcgcgagctggtaaaacatatgccgtgggatgatgtcaaagattgtgcagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctaaattacgtggattataacatcatattccggcgtatgaattgatgagttgtacatcttgacattttcttctttcttctcttctccctttcccagaaacaaactttttttacccactataaaataaaatgagtatactacctattatatttctttctatatttttttattcttcattcgttcagacttttaacgcgtctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagatcttatctcgtatccacaaatagtaaatgagagatctactggcgaaatggtatgtcccaatattaatgcatttattgctagtaacgtaaacgcagatattatatggagcggacatcgacgccttagaaataagagacttaaacaacggacacctggaattattaccatagaagatgttagaaaaaatgatgctggttattatacatgtgttttagaatatatatacggtggcaaaacatataacgtaaccagaattgtaaaattagaggtacgggataaaataataccttctactatgcaattaccagatggcattgtaacttcaataggtagtaatttgactattgcgtgtagagtatcgttgagacctcccacaacggacaccgacgtcttttggataagtaatggtatgtattacgaagaagatgatggggacggaaacggtagaataagtgtagcaaataaaatctatatgaccgataagagacgtgttattacatcccggttaaacattaatcctgttaaggaagaagatgctacaacgtttacgtgtatggcgtttactattcctagcatcagtaaaacagttactgttagtataacgtgaatgtatgttgttacatttccatgtcaattgagtttataagaatttttatacattatcttccaacaagcaattgacgaacgtattgctatgattaactcccacgatactatgcatattattaatcattaacttgcagactatacctagagctattttgacatactcgtgttcttgtgtaattgcagtatctatattattaaagtacgtaaatctagctatagttttattatttaattttagataatataccgtctccttatttttaaaaattgccacatcctttattaaatcatgaatgggaatttctatgtcatcgttagtatattgtgaacaacaagagcagatatctataggaaagggtggaatgcgatacattgatctatgtagttttaaaacacacgcgaactttgaagaatttatataaatcattccatcgatacatccttctatgttgacatgtatatatccaggaattcgtttattaatatcgggaaatgtataaactaaaacattgcccggaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtgcttgtatgtgttataaatataacgggatatagaactgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctgtcttcgatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcgaatcaactcataaaatacaagagaatgaaatatatacatattttagtcattgcaatatagaccatacttctacagaacttgattttgtagttaaaaactatgatctaaacagacgacaacctgtaactgggtatactgcactacactgctatttgtataataattactttacaaacgatgtactgaagatattattaaatcatggagtggatgtaacgatgaaaaccagtagcggacgtatgcctgtttatatattgcttactagatgttgtaatatttcacatgatgtagtgatagatatgatagacaaagataaaaaccacttatcgcatagagactattccaacctactactagagtatataaaatctcgttacatgttattgaaggaagaggatatcgatgagaacatagtatcaactttattagataagggaatcgatcctaactttaaacaagacggatatacagcgttacattattattatttgtgtctcgcacacgtttataaaccaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcaaaatatgtaataatcatggattaacgcctatactatgttatataacttccgactacatacaacacgatattcttgttatgttaatacatcactatgaaacaaatgttggagaaatgccgatagatgagcgtcgtataatcgtattcgagtttatcaaaacatattctacacgtccggcagattcgataacttatttgatgaataggtttaaaaatataaatatttatacccgctatgaaggaaagacattattacacgtagcatgtgaatataataatacacaagtaatagattatcttatacgtatcaacggagatataaatgcgttaaccgacaataacaaacacgctatccaactcattatagataacaaagaaaattccccgtataccatcgattgtttattgtatatacttagatatattgtagataagaatgtgataagatcgttggtggatcaacttccatctctacctatcttcaatataaaatcatttgagaaattcatatcctactgtatacttttagatgacacattttacaataggcacgttaggaatcgcaattctaaaacgtatcgatacgcattttcaaaatacatgtcgtttgataaatacgatggtataataactaaatgtcataaagaaacaatattgctcaaactatccactgttctagacactacactatatgcagttttaagatgccataattcgaaaaagttaagaagatacctcaacgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatatcgtatccacctaccaaagtatagttgtatttttctcatgcgatgtgtgtaaaaaaactgatattatataaatattttagtgccgtataataaagatgacgatgaaaatgatggtacatatatatttcgtatcattatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatggccactctaggagagccattcagcgcaaagtgtcctcctattgaagacagtcttttatcgcacagatataaagactatgtggttaaatgggaaaggctagaaaagaatagacggcgacaggtttctaataaacgtgttaaacatggtgatttatggatagccaactatacatctaaattcagtaaccgtaggtatttgtgtaccgtaactacaaagaatggtgactgtgttcagggtatagttagatctcatattagaaaacctccttcatgcattccaaaaacatatgaactaggtactcatgataagtatggcatagacttatactgtggaattctttacgcaaaacattataataatataacttggtataaagataataaggaaattaatatcgacgatattaagtattcacaaacgggaaagaaattaattattcataatccagagttagaagatagcggaagatacgactgttacgttcattacgacgacgttagaatcaagaatgatatcgtagtatcaagatgtaaaatacttacggttataccgtcacaagaccacaggtttaaactaaaaagaaattgcggatatgcgtcaaattaaaataaatggtacggacatgcttacagtgatgtacatgttaaataaacctacaaagaaacgatatgttaataatccgatatttacagattgggctaataagcaatataagttttataatcaaataatatataatgctaataagttaatagaacaaagtaagaaaatagacgacatgatagaggaggtatccattgacgataatcgtttatcaacactaccgttagaaattagacatttgattttctcgtacgcgttcctataaaaatagaaactataatcatataatagtgtaggttggtagtattgctcttgtgactagagactttagttaaggtactgtaaaaatagaaactataatcatataatagtgtaggttggtagtagggtactcgtgattaattttattgttaaacttgtccttaagtcttattaatatgtcttctaaagggggtagtggcggcatgtggagtgtctttatccatggacatgatggtagtaataaaggatctaaaacttatacatctggtggcggtggaatgtggggaggaggatcgtccagtggggttaacggaggtgtaaaatctggaactggtaaaatttaaacactaaattatttttattaataattgtacaagtttttgacatgatatttaatgacattagttgtgtgggtgtatagagttcacagtagctcattcagtcaaaatgtttgactatttggaaaatgaggaggtggctctcgatgaacttaaacagatgttgagagacagagatcctaatgataccaggaaccaattcaagaataatgctttacacgcatacctttttaatgagcattgtaataatgtcgaggtcgtcaaactactactagacagtggcactaatccattacgcaaaaattggagacagctaccccattagaagaatacacaaatagtagacatgttaaagttaaaggatatagcgatggctctactagaagccactggatttagcaacataaatgactttaatatattcagctatatgaaatccaaaaatgtagacgttgacttgataaaggtgttggtagaacatggatttgacttgagtgttaaatgtgaaaaccatcgttcagttatagaaaattatgtaatgacaatgatcctgttcctaaaattattgatttgttcatagaaaatggctgcagtgttctttatgaggacgagtactgatacgcgtatgatgattatcaactacgaaattgcggtaccgtattgcatctgtattcaaagtcggatacgagagcatatgtgcgtccggaagttgttaaatgtctaattaatcacggaatcaagccgtcttttatagataaaaactattgtacagctcttcaatattatattaagtcatctcatatagatatagacatcgttaaattgttaatgaaaggaatagataacactgcttattcatatatagacgatctaacatgttgcactcgaggaattatggctgattatctaaatagtgattatagatacaataaagatgtagatttggtcaaattgtttttggagaatggaaagcctcacggaataatgtgtagtattgtaccactatggagaaatgataaggaaaccatctttttgatattgaaaacaatgaactcggatgtcctccaacatatactaattgagtatatgacattcggcgatatccctctagtggaatatggaactgtggtaaataaagaggctatacacggatactttagaaatattaatattgattcttacacgatgaaatatctactaaaaaaggaagggagatgccatcaattatctcgatgatggagagatcccgattggacacctatgtaaatccaactatgaatgttataatttttacacttatacatacaaaaagggtctttgtgacatgtcttatgcttgcccaattcttagtactataaacatttgcctaccttatcttaaagacattaacatgattgacaaacgaggagaaacacttcttcacaaggctgttagatataataaacaatctctagtatctttactgctagaatccggttcagatgtcaacattagatcaaataacggatatacatgtatagccattgccatcaacgaatctaaaaacattgaactgctgaaaatgctattatgtcataaacctacattagattatgtgattgattcattgagagaaatatctaacatcgtagataactactatgctataaaacaatgtattaaatatgccatgattatagatgactgtacatcgtctaagattccagagtccataagtcaacgctataatgattatatagatctttgcaattaagaattgaatgagatgaaaaaaataatggtaggtggtaatactatgttctcattaatatttactgatcatggagctaaaattattcatagatatgccaataatccagaattacgtgagtattatgagttaaaacaaaataaaatatatgtggaagcatatgatattatttccaacgcaatagtgaaacatgatagaatacataaaaccatagaatcagttgatgataatacctacatttctaatcttccgtataccatcaaatacaaaatattcgagcaacaataagtattttttatacctttaaaattgataaataaattttttctagtgatattttggcaagatgagaatcctatttctcatcgccttcatgtatgggtgtgttcacccatatgttaatgccgacgaaatcaaatgtcctaacctaaacatcgtaacatcttctggagaatttcgttgcactggatgtgtgaaatttatgcctaattttagctacatgtattggttggcaaaggatatgagatcggacgaggataccaagtttatagaacatctgggtgatggcatcaaagaagatgaaaccgttcgtaccatagatggtagaatcgtcactctacagaaagtccttcatgtaaccgatactaataaatttgctcattataggttcacttgtgtcctcactacgatagatggcatttataaaaagaatgtttgctgaagtagttgtgtgctactatttttatttatgatataatctaaatgcaattgtcttgagaatccatccaatacggcagattatattagaaacaacgaattgaattgaatttaatctttcatacgagaaaaataacgacatacgtcgtcaacaaattaaactttttatttattagttaactagcttatagaacttgctcattgttatgtttctaaaacgggtacgacatataggacaattatccgacgcaccggtttctcttcgtgttttatgccatatattgatacatgttatgcaaaatatatgattacacgaatccaataaaccaaagtatctatcgttttgagtaaacaacttcatagcaaattccacattctttttctttacttactctatacacgtcctcgtatttatccagtattttgatgatatccaactcagaaatggttgttgtattattgggtgtataggtattattagctatgtaccaatttaccaaccttcttaatattgattgataatcacatcggttatccaattaataactaaattgtagtgtatatatagaccatatatgtttctatttttttgacagttacgtatagtttcagtaagttttgattgttgtattcctgtatctctagataagttagtcatatagtcccttccggcgatacgttttttccaagcccgaaattgattagccaaatgtggatttatttttgtgatattgatataatatttcggataatgcatactgttagtcttatatcatttggttcatctatgtattgtaatattgttacatgatctatagatgatgtattgattttggcaggatcgaattccatatccgcgactaaacagtgaaaaaaatgtaaatactttttaaattttaaattagtaaaacttttttttattttttatgattccaaaaatactgaatacaaagtcctaaattataaatatggagatcatactaccacaacttattattatgtatacaaggccggtgtaatagatagatatatataattctattacaccggcagacaattaccgatcggtatttgtcgttaccaacataccgtataatatgtaatatacaattccataacccattgacagttgttatacatcaaaattgcaattcttttgattacgatgttataagaatgtagttaattgatgtatgatgttaatgtgtcctctttcctcttataacatcgtaatcaaaaacttttttataatatatacctaataatgtgtcttaatagttctcgtgattcgtcaaacaatcattcttataaaatataataaatcaacgtaaaaacacataaaaataagcgtaactaataagacaatggatatttacgacgataaaggtctacagactattaaactgtttaataatgaatttgattgtataaggaatgacatcagagaattatttaaacatgtaactgattccgatagtatacaacttccgatggaagacaattctgatattatagaaaatatcagaaaaatactatatagacgattaaaaaatgtagaatgtgttgacatcgataacacaataacttttatgaaatacgatccaaatgatgataataagcgtacgtgttctaattgggtacccttaactaataactatatggaatattgtctagtaatatatttggaaacaccgatatgtggaggcaaaataaaattataccaccctacaggaaatataaagtcggataaggatattatgtttgcaaagactctagactttaaatcaaagaaagtgttaactggacgtaagacaattgccgttctagacatatccgtttcatataatagatcaataactactattcactacaacgacgacgttgatatagatatacatactgataaaaatggaaaagagttatgttattgttatataacaatagatgatcattacttggttgatgtggaaactataggagttatagtcaatagatctggaaaatgtctgttagtaaataaccatctaggtataggtatcgttaaagataaacgtataagcgatagttttggagatgtatgtatggatacaatatttgacttttctgaagcacgagagttattttcattaactaatgatgataacagaaatatagcatgggacactgataaactagacgatgatacagatatatggactcccgtcacagaagatgattacaaatttctttctagactagtattgtatgcaaaatctcaatcggatactgtattcgactattatgttcttactggtgatacggaaccacccactgtattcattttcaaggtaactagattttactttaatatgctgaaataaaaaatttttgtataatatctagaggtagaggtattgtttagataaatacaaataacatagatacatcgcatatttagcatttttataaatatacataagacatacactttatacatttttgtaaaaatactcataaaaaaaatttataaaaattatggcacaaccatatcttgtagaggtagtttagttcgtcgagtgaacctataaacagataatagacaacacataataataatgcctactaatacaagcataataccgggagatgggatatatgacgttgtagtgtttggtttttctgaacgttgatagtctactaatactacatgctgacatctaatgcctgtataaccatgagagcatctacaatacataccgtcgatatctctagcgtggatacagtcaccgtgtaaacaatatccatctccctctggaccgcataatctgatagctggaatatctgttgtagcgtttgtaatttctggcaatgtcgtttcgatagcgttaccactatcggcgaatgatctgattatcatagcagcgaacaacaacatcagatatttcatcgacatttttgatggattctgtgtttatgctgtttctcagtgtgtgtttatgacaagattgggaattttatattattaattcagtaatataaactaataatatattgttaattgtgtaaataatataaaaataacaatacaatattgaatgtgttgctgttaaaaatgtatgtgttaatataatagaataaaataaatgagtatgatcattttagataacgattgattttatcattacccttcattcttatattctttgcttacggaacctatatttagaaacatctactaacgattttttatgcttgcattattaatggtatgtaataccaatttgttaagtatgaatacggggtacaaacataaactgaaatttaacattatttatttatgatatatatcgttatcgttattgtttggtctataccatggatatctttaaagaactaatcgtaaaacaccctgatgaaaatgttttgatttctccagtttccattttatctactttatctattctaaatcatggagcagctggttctacagctgaacaactatcaaaatatatagagaatatgaatgagaatacacccgatgataagaaggatgacaataatgacatggacgtagatattccgtattgtgcgacactagctaccgcaaataaaatatacggtagcgatagtatcgagttccatgcctccttcctacaaaaaataaaagacgattttcaaactgtaaactttaataatgctaaccaaacaaaggaactaatcaacgaatgggttaagacaatgacaaatggtaaaattaattccttattgactagtccgctatccattaatactcgtatgacagttgttagcgccgtccattttaaagcaatgtggaaatatccattttctaaacatcttacatatacagacaagttttatatttctaagaatatagttaccagcgttgatatgatggtgggtaccgagaataacttgcaatatgtacatattaatgaattattcggaggattctctattatcgatattccatacgagggaaactctagtatggtgattatactaccggacgacatagaaggtatatataacatagaaaaaaatataacagatgaaaaatttaaaaaatggtgtggtatgttatctactaaaagtatagacttgtatatgccaaagtttaaagtggaaatgacagaaccgtataatctggtacctattctagaaaatttaggacttactaatatattcggatattatgcagattttagcaagatgtgtaatgaaactatcactgtagaaaaatttctacatacgacgtttatagatgttaatgaggagtatacagaagcatcggccgttacaggagtatttatgactaacttttcgatggtatatcgtacgaaggtctacataaaccatccattcatgtacatgattaaagacaacacaggacgtatactttttatagggaaatactgctatccgcaataaatataaacaaatagacttttatcacgtttatctatgtctaaatattacaaatagtataaactaaagctgataatacttaaaaaaataataatatcatttacaattaatagtataaactaaaaattaaacaaatcgttattataagtaatatcaaaatgatgatatacggattaatagcgtgtcttatattcgtgacttcatccatcgctagtccactttatattcccgttattccacccattacggaagataaatcgttcaatagtgtagaggtattagtttccttgtttagagatgaccaaaaagactatacggtaacttctcagttcaataactacactatcgataccaaagactggactatcggcgtactatccacacctgatggtttggatataccattgactaatataacttattggtcacggtttactataggtcgtgcattgttcaaatcagagtctgaggatattttccaaaagaaaatgagtattctaggtgtttctatagaatgtaagaagtcgtcgacattacttacttttttgaccgtgcgtaaaatgactcgagtatttaataaatttccagatatggcttattatcgaggagactgtttaaaagccgtttatgtaacaatgacttataaaaatactaaaactggagagactgattacacgtacctctctaatggggggttgcctgcatactatcgtaatggggtcgatggttgattattgattagtatattccttattcacacaaaaagaacatttttataaacatgaaaccactgtctaaatgtaattatgatcttgatttatagatgaagatcagcctttagaggattttaaccagtatgtttaatatgaaaaaaataaacataacatattttgagattaagcgctattgtgcttaattattttgctctataaactgaatatatagccacaattattgacgggcttgtttatgaccggcaatcatgaatttacagaaattatctctggctatatatcttactgcgacatgttcgtggtgttatgaaacatgcataagaaaaactgcgttgtatcatgacattcaattggagcatgtagaagacaataaagatagtgtagcgtcgctaccgtacaagtagtcaatcaaagagaacgtagtagattgttggctacatttaattggacagatatagctgagggtgttagaaatgagttcattaaaatatgtgatatcaacggaacatatttatataattatactattgctgttagtataattattgattccacggaagaactaccaacagttactccaattacaacaacatatgaaccttctacatataattatactatcgatgatagcactgttattactactgaagaactacaagtgactcctcatatggatctccatcgatgatacatgtattaaaatactttccgaataagtcttttaaatattgtattaattatgaaaaactatgctatgcgagtatgatgcaaagatgtttaatgatacgatactagattttatctctagcgagagatgtcgttagaatcatttatcataactacgtttaataataattcatcaacgaatatcgataacatgtgtcatttatacgttaaagtctgtccgtcttctctattgtttagactgtttgtagaatgctgtgatataaacaaactagtagaaggtacgactccgttacactgttatctaatgaatgaaggatttgaatcatctgttttaaaaaacctattaaaggagtatgtcatgacagtgatggtcacattccattacacaaatatttaactcatgatgaagttgagaatgatatgctttctgatagtatagatagctttagctaatataaaaatatattaatccactatatattctagacttgatttaaaaccgataaactactacgtactgtataagttgttaagaaaaggagcagaccctaattatgcagatgatagaggtaatacttttcttcattacttctgcatctatatgtccacttatgagaaaacgtcatttaataagatgcatcgtgaaaagaaatttattaaagagttggtaaaatatgaaaccgaaagtaaataatataggaaatacacctctacataactacgtatctcaatatgatatcactctcattcctcatccacaacccattaaaaaaatggaaattaaagccctctattagcataaacggctacaggtctacctttacaatggcctttccttgtgcccagttcagaccctgtcattgccacgctactaaggactccctgaataccgtggccgacgtcagacattgtctgactgaatacatcctgtgggtttctcatagatggacccatagagaaactgcagggcctctctacaggcttctcatctctttcagaactgatgcaacggagctctttggtggtgagttgaaggattcacttccgtgggacaatatcgacaattgcgtggagatcattaaatgtttcatcagaaatgactccatgaaaaccgccgaagaacttcgtgcaatcattggactttgtactcaatcagctatcgtctctggaagagtcttcaacgataagtatatcgacatactacttatgctgcgaaagattctgaacgagaacgactatctcaccctcttggatcatatccgcactgctaaatactaaatctccttcatgctctctcactacactttttatcatcttatgaggaatgattgccttcatcatttttcgtgaaataggaataattagcaccagaatagctatggattgcacatgtattctatgtcgtctactggatgaagatgtgacgtacaaaaaaataaaactagaaattgaaacgtgtcacaacttatcaaaacatatagatagacgaggaaacaatgcgctacattgttacgtcttcaataaatgcgatacagacattaagattgttcgactgttactctctcgcggagtcgagagactttgtagaaacaacgaaggattaactccgctaggagtatacagtaagcatagatacgtcaaatctcaaattgtgcatctactgatatccagctattcgaattcctctaacgaactcaagtcgaatataaatgatttcgatctgtattcggataatatcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacaacagtgatatgtgtaagaactctcttcattactatatatcgtctcatagagaatctcaatctctatccaaggatgtaattaaatgtttgatcaataacaatgtttccatccatggcagagacgaaggaggatctttacccatccaatactactggtctttctcaaccatagatatagagattgttaaattattattaataaaggatgtggacacgtgtagagtatacgacgtcagccctatattagaggcgtattatctaaacaagcgatttagagtaaccccatataatgtagacatggaaatcgttaatcttcttattgagagacgtcatactcttgtcgacgtaatgcgtagtattacttcgtacgattccagagaatataaccactacatcatcgataacattctaaagagatttagacaacaggatgaatccatcgtacaagccatgttgataaactacttacattacggcgatatggtcgttcgatgcatgttagataacggacaacaactatcctctgcacgactactttgttaataataatctcgtcgatgtaaacgtcgtaaggtttatcgtggaaaatatggacacgcggctgtaaatcacatatctaacaatggccgtctatgtatgtacggtctgatattatcgagatttaataattgcgggtatcactgttatgaaaccatactaatagatgtatttgatatactaagcaagtacatggataatatagatatgatcgataatgagaataaaactctactatattacgcggtcgatgtcaataatatacaatttgcaaagcggttattggaatatggagcgagtgttacaacatcacgctcgataatcaatacggccatccagaaaagtagttacagaagagaaaacaaaacgaagctagttgatttattacttagctaccatcccactctagagactatgattgacgcatttaatagagatatacgctatctatatcctgaaccattattcgcctgtatcagatacgccttaatcatagatgatgattttccttctaaagtaaagtatgatatcgccggtcgtcataaggaactaaagcgctatagagtagacattaatagaatgaagaatgcctacatatcaggcgtctccatgtttgatatattatttaaacgaagcaaacgccacagattgagatacgcaaagaatccgacatcaaatggtacaaaaaagaactaacgtccatcattacagaaactgtaaagaacaatgagaggatcgactccatagtggacaacattaatacagacgataacttgatttcgaaattacccatggagatactttattactccattaaataatttatcatggagcgataatgtcctgtttcatttgtttccatgacatattacaaaatcgattccgtccaagatgataaaaacatttaccggcatcataaacacggagtttattttatatgtctcgcataaacattactaaaaaaatatattgttcggttttctttcacatctttaattatgaaaaagtaaatcattatgagatggacgagattgtacgcatcgttcgcgacagtatgtggtacatacctaacgtatttatggacgacggtaagaatgaaggtcacgtttctgtcaacaatgtttgtcatatgtattttacgttctttgatgtggatacatcgtctcatctgtttaagctagttattaaacactgcgatctgaataaacgaggtaactctccattacattgctatacgatgaatacacgatttaatccatctgtattaaagatattgttacaccacggcatgcgtaactttgatagcaaggatgaccactatcaatcgataacaagatctttgatatactaacggacaccattgatgactttagtaaatcatccgatctattgctgtgttatcttagatataaattcaatgggagcttaaactattacgttctgtacaaaggatccgaccctaattgcgccgacgaggatgaactcacttctcttcattactactgtaaacacatatccacgttctacaaaagcaattattacaagtcaagtcacactaagatgcgagccgagaagcgattcatctacgcgataatagattatggagcaaacattaacgccgttacacacttaccttcaacagtataccaaacatagtcctcgtgtggtgtatgctcttttatctcgaggatacgtaataatcttgattgtacacccatcatggaacgattgtgcaacaggtcatattctcataatgttactcaattggcacgaacaaaaggaagaaggacaacatctactttatctattcataaaacataatcaaggatacactctcaatatactacggtatctactagataggttcgacattcagaaagacgaatattataataccgcctttcaaaattgtaacaacaatgttgcctcatacatcggatacgacatcaaccttccgactaaagacggtattcgacttggtgtttgaaaacagaaacatcatatacaaggcggatgttgtgaatgacatcatccaccacagactgaaagtacctatgattaaatcgttgttctacaagatgtcagaattctctccctacgacgattactacgtaaaaaagatactagcctactgcctattaagggacgagtcattcgcggaactacatagtaaattctgtttaaacgaggactataaaagtgtatttatgaaaaatatatcattcgataagatagattccatcatcgtgacataagtcgccttaaagagattcgaatctccgacaccgacctgtatacggtatcacagctatcttaaagccatacattcagacagtcacatttcatttcccatgtacgacgatctcatagaacagtgccatctatcgatggagcgtaaaagtaaactcgtcgacaaagcactcaataaattagagtctaccatcgatggccaatctagactatcgtatttgcctccggaaattatgcgcaatatcatctaaacagtatgttgtacggaaagaaccattacaaatattatccatgatagaaagaaaatatctatatgattggagaagtaggaaacaggaacaagacaacgattactacattattaaattatgaagtccgtattatactcgtatatattgtttctctcatgtataataataaacggaagagatatagcaccgcatgcaccatccgatggaaagtgtaaagacaacgaatacaaacgccataatttgtgtccgggaacatacgcttccagattatgcgatagcaagactaacacacaatgtacgccgtgtggttcgggtaccttcacatctcgcaataatcatttacccgcttgtctaagttgtaacggaagatgcgatcgtgtaacactactcacaatagaatctgtgaatgctctcccggatattattgtcttctcaaaggatcatccggatgcaaggcatgtgtttcccaaacaaaatgtggaataggatacggagtatccggagacgtcatctgttctccgtgtggtctcggaacatattctcacaccgtctcttccgcagataaatgcgaacccgtacccagaaatacgtttaactatatcgatgtggaaattaacctgtatccagttaacgacacatcgtgtactcggacgaccactaccggtctcagcgaatccatctcaacgtcggaactaactattactatgaatcataaagactgcgatcccgtctttcgtgatggatacttctctgtccttaataaggtagcaacttcaggtttctttacaggagaaaggtgtgcactctgaatttcgagattaaatgcaataacaaagattcttcctccaaacagttaacgaaagcaaagaatgatactatcatgccgcattcggagactgtctatctagcgtcgacatctatatactatatagtaataccaatactcaagactacgaaactgatacaatctcttatcatgtgggtaatgttctcgatgtcgatagccatatgcccggtagttgcgatatacataaactgatcactaattccaaacccacccgctttttatagtaagtttttcacccataaatacaataattaatttctcgtaaaagtagaaaatatattctaatttattgcacggtaaggaagtagaatcataaagaacagtaatcaatcaatagcaatcatgaaacaatatatcgtcctggcatgcatgtgcctgccagtcttcagcaatcctcctcctcgtgtacggaagaagaaaacaaacatcatatgggaatcgatgttattatcaaagtcacaaagcaagaccaaacaccgaccaatgataagatttgccaatccgtaacggaaattacagagtccgagtcagatccagatcccgaggtggaatcagaagatgattccacatcagtcgaggatgtagatcctcctaccacttattactccatcatcggtggaggtctgagaatgaactttggattcaccaaatgtcctcagattaaatccatctcagaatccgctgatggaaacacagtgaatgctagattgtccagcgtgtccccaggacaaggtaaggactctcccgcgatcactcatgaagaagctcttgctatgatcaaagactgtgaggtgtctatcgacatcagatgtagcgaagaagagaaagacagcgacatcaagacccatccagtactcgggtctaacatctctcataagaaagtgagttacgaagatatcatcggttcaacgatcgtcgatacaaaatgcgtcaagaatctagagtttagcgttcgtatcggagacatgtgcaaggaatcatctgaacttgaggtcaaggatggattcaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaatgttcttaactacattcacaaaaagttacctctcgcgacttcttctttttctgtctcaatagtgtgatacgattatgacactattcctattcctattcctatttcctttcagggtatcacaaaaatattaaacctctttctgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagtattacaaaaatatttttatactctttctctctatgatggtctcataaaaaaagtattacaacaatatgattatgctcttactctctatgatggtctcataacataagtttacaacaatatgatgatctcatacctctgg

SEQ ID NO: 3 - DNA, 723 bp, vaccinia virus
  CDS (1)...(723)
atgcatgtgcctgccagtcttcagcaatcctcctcctcgtgtacggaagaagaaaacaaacatcatatgggaatcgatgttattatcaaagtcacaaagcaagaccaaacaccgaccaatgataagatttgccaatccgtaacggaaattacagagtccgagtcagatccagatcccgaggtggaatcagaagatgattccacatcagtcgaggatgtagatcctcctaccacttattactccatcatcggtggaggtctgagaatgaactttggattcaccaaatgtcctcagattaaatccatctcagaatccgctgatggaaacacagtgaatgctagattgtccagcgtgtccccaggacaaggtaaggactctcccgcgatcactcatgaagaagctcttgctatgatcaaagactgtgaggtgtctatcgacatcagatgtagcgaagaagagaaagacagcgacatcaagacccatccagtactcgggtctaacatctctcataagaaagtgagttacgaagatatcatcggttcaacgatcgtcgatacaaaatgcgtcaagaatctagagtttagcgttcgtatcggagacatgtgcaaggaatcatctgaacttgaggtcaaggatggattcaagtatgtcgacggatcggcatctgaaggtgcaaccgatgatacttcactcatcgattcaacaaaactcaaagcgtgtgtc

SEQ ID NO: 4 - protein, 241 aa, vaccinia virus
MHVPASLQQSSSSCTEEENKHHMGIDVIIKVTKQDQTPTNDKICQSVTEITESESDPDPEVESEDDSTSVEDVDPPTTYYSIIGGGLRMNFGFTKCPQIKSISESADGNTVNARLSSVSPGQGKDSPAITHEEALAMIKDCEVSIDIRCSEEEKDSDIKTHPVLGSNISHKKVSYEDIIGSTIVDTKCVKNLEFSVRIGDMCKESSELEVKDGFKYVDGSASEGATDDTSLIDSTKLKACV

SEQ ID NO: 5 - DNA, 441 bp, vaccinia virus
  CDS (1)...(441)
atgcgatcgtgtaacactactcacaatagaatctgtgaatgctctcccggatattattgtcttctcaaaggatcatccggatgcaaggcatgtgtttcccaaacaaaatgtggaataggatacggagtatccggagacgtcatctgttctccgtgtggtctcggaacatattctcacaccgtctcttccgcagataaatgcgaacccgtacccagaaatacgtttaactatatcgatgtggaaattaacctgtatccagttaacgacacatcgtgtactcggacgaccactaccggtctcagcgaatccatctcaacgtcggaactaactattactatgaatcataaagactgcgatcccgtctttcgtgatggatacttctctgtccttaataaggtagcaacttcaggtttctttacaggagaaaggtgtgcactctga

SEQ ID NO: 6 - protein, 146 aa, vaccinia virus
MRSCNTTHNRICECSPGYYCLLKGSSGCKACVSQTKCGIGYGVSGDVICSPCGLGTYSHTVSSADKCEPVPRNTFNYIDVEINLYPVNDTSCTRTTTTGLSESISTSELTITMNHKDCDPVFRDGYFSVLNKVATSGFFTGERCAL

SEQ ID NO: 7 - DNA, 369 bp, vaccinia virus
  CDS (1)...(369)
atgaagtccgtattatactcgtatatattgtttctctcatgtataataataaacggaagagatatagcaccgcatgcaccatccgatggaaagtgtaaagacaacgaatacaaacgccataatttgtgtccgggaacatacgcttccagattatgcgatagcaagactaacacacaatgtacgccgtgtggttcgggtaccttcacatctcgcaataatcatttacccgcttgtctaagttgtaacggaagatgcgatcgtgtaacactactcacaatagaatctgtgaatgctctcccggatattattgtcttctcaaaggatcatccggatgcaaggcatgtgtttcccaaacaaaatgtggaatag

SEQ ID NO: 8 - protein, 122 aa, vaccinia virus
MKSVLYSYILFLSCIIINGRDIAPHAPSDGKCKDNEYKRHNLCPGTYASRLCDSKTNTQCTPCGSGTFTSRNNHLPACLSCNGRCDRVTLLTIESVNALPDIIVFSKDHPDARHVFPKQNVE

SEQ ID NO: 9 - DNA, 336 bp, vaccinia virus
  CDS (1)...(336)
atgttgcctcatacatcggatacgacatcaaccttccgactaaagacggtattcgacttggtgtttgaaaacagaaacatcatatacaaggcggatgttgtgaatgacatcatccaccacagactgaaagtacctatgattaaatcgttgttctacaagatgtcagaattctctccctacgacgattactacgtaaaaaagatactagcctactgcctattaagggacgagtcattcgcggaactacatagtaaattctgtttaaacgaggactataaaagtgtatttatgaaaaatatatcattcgataagatagattccatcatcgtgacataa

SEQ ID NO: 10 - protein, 111 aa, vaccinia virus
MLPHTSDTTSTFRLKTVFDLVFENRNIIYKADVVNDIIHHRLKVPMIKSLFYKMSEFSPYDDYYVKKILAYCLLRDESFAELHSKFCLNEDYKSVFMKNISFDKIDSIIVT

SEQ ID NO: 11 - DNA, 387 bp, vaccinia virus
  CDS (1)...(387)
atggagcaaacattaacgccgttacacacttaccttcaacagtataccaaacatagtcctcgtgtggtgtatgctcttttatctcgaggatacgtaataatcttgattgtacacccatcatggaacgattgtgcaacaggtcatattctcataatgttactcaattggcacgaacaaaaggaagaaggacaacatctactttatctattcataaaacataatcaaggatacactctcaatatactacggtatctactagataggttcgacattcagaaagacgaatattataataccgcctttcaaaattgtaacaacaatgttgcctcatacatcggatacgacatcaaccttccgactaaagacggtattcgacttggtgtttga

SEQ ID NO: 12 - protein, 128 aa, vaccinia virus
MEQTLTPLHTYLQQYTKHSPRVVYALLSRGYVIILIVHPSWNDCATGHILIMLLNWHEQKEEGQHLLYLFIKHNQGYTLNILRYLLDRFDIQKDEYYNTAFQNCNNNVASYIGYDINLPTKDGIRLGV

SEQ ID NO: 13 - DNA, 411 bp, vaccinia virus
  CDS (1)...(411)
atgtctcgcataaacattactaaaaaaatatattgttcggttttctttcacatctttaattatgaaaaagtaaatcattatgagatggacgagattgtacgcatcgttcgcgacagtatgtggtacatacctaacgtatttatggacgacggtaagaatgaaggtcacgtttctgtcaacaatgtttgtcatatgtattttacgttctttgatgtggatacatcgtctcatctgtttaagctagttattaaacactgcgatctgaataaacgaggtaactctccattacattgctatacgatgaatacacgatttaatccatctgtattaaagatattgttacaccacggcatgcgtaactttgatagcaaggatgaccactatcaatcgataacaagatctttgatatac

SEQ ID NO: 14 - protein, 137 aa, vaccinia virus
MSRINITKKIYCSVFFHIFNYEKVNHYEMDEIVRIVRDSMWYIPNVFMDDGKNEGHVSVNNVCHMYFTFFDVDTSSHLFKLVIKHCDLNKRGNSPLHCYTMNTRFNPSVLKILLHHGMRNFDSKDDHYQSITRSLIY

SEQ ID NO: 15 - DNA, 594 bp, vaccinia virus
  CDS (1)...(594)
atgtacggtctgatattatcgagatttaataattgcgggtatcactgttatgaaaccatactaatagatgtatttgatatactaagcaagtacatggataatatagatatgatcgataatgagaataaaactctactatattacgcggtcgatgtcaataatatacaatttgcaaagcggttattggaatatggagcgagtgttacaacatcacgctcgataatcaatacggccatccagaaaagtagttacagaagagaaaacaaaacgaagctagttgatttattacttagctaccatcccactctagagactatgattgacgcatttaatagagatatacgctatctatatcctgaaccattattcgcctgtatcagatacgccttaatcatagatgatgattttccttctaaagtaaagtatgatatcgccggtcgtcataaggaactaaagcgctatagagtagacattaatagaatgaagaatgcctacatatcaggcgtctccatgtttgatatattatttaaacgaagcaaacgccacagattgagatacgcaaagaatccgacatcaaatggtacaaaaaagaac

SEQ ID NO: 16 - protein, 198 aa, vaccinia virus
MYGLILSRFNNCGYHCYETILIDVFDILSKYMDNIDMIDNENKTLLYYAVDVNNIQFAKRLLEYGASVTTSRSIINTAIQKSSYRRENKTKLVDLLLSYHPTLETMIDAFNRDIRYLYPEPLFACIRYALIIDDDFPSKVKYDIAGRHKELKRYRVDINRMKNAYISGVSMFDILFKRSKRHRLRYAKNPTSNGTKKN

SEQ ID NO: 17 - DNA, 1146 bp, vaccinia virus
  CDS (1)...(1146)
atgattgccttcatcatttttcgtgaaataggaataattagcaccagaatagctatggattgcacatgtattctatgtcgtctactggatgaagatgtgacgtacaaaaaaataaaactagaaattgaaacgtgtcacaacttatcaaaacatatagatagacgaggaaacaatgcgctacattgttacgtcttcaataaatgcgatacagacattaagattgttcgactgttactctctcgcggagtcgagagactttgtagaaacaacgaaggattaactccgctaggagtatacagtaagcatagatacgtcaaatctcaaattgtgcatctactgatatccagctattcgaattcctctaacgaactcaagtcgaatataaatgatttcgatctgtattcggataatatcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacaacagtgatatgtgtaagaactctcttcattactatatatcgtctcatagagaatctcaatctctatccaaggatgtaattaaatgtttgatcaataacaatgtttccatccatggcagagacgaaggaggatctttacccatccaatactactggtctttctcaaccatagatatagagattgttaaattattattaataaaggatgtggacacgtgtagagtatacgacgtcagccctatattagaggcgtattatctaaacaagcgatttagagtaaccccatataatgtagacatggaaatcgttaatcttcttattgagagacgtcatactcttgtcgacgtaatgcgtagtattacttcgtacgattccagagaatataaccactacatcatcgataacattctaaagagatttagacaacaggatgaatccatcgtacaagccatgttgataaactacttacattacggcgatatggtcgttcgatgcatgttagataacggacaacaactatcctctgcacgactactttgt

SEQ ID NO: 18 - protein, 382 aa, vaccinia virus
MIAFIIFREIGIISTRIAMDCTCILCRLLDEDVTYKKIKLEIETCHNLSKHIDRRGNNALHCYVFNKCDTDIKIVRLLLSRGVERLCRNNEGLTPLGVYSKHRYVKSQIVHLLISSYSNSSNELKSNINDFDLYSDNIDLRLLKYLIVDKRIRPSKNTNYAINGLGLVDIYVTTPNPRPEVLLWLLKSECYSTGYVFRTCMYNSDMCKNSLHYYISSHRESQSLSKDVIKCLINNNVSIHGRDEGGSLPIQYYWSFSTIDIEIVKLLLIKDVDTCRVYDVSPILEAYYLNKRFRVTPYNVDMEIVNLLIERRHTLVDVMRSITSYDSREYNHYIIDNILKRFRQQDESIVQAMLINYLHYGDMVVRCMLDNGQQLSSARLLC

SEQ ID NO: 19 - DNA, 546 bp, vaccinia virus
  CDS (1)...(546)
atgatatcactctcattcctcatccacaacccattaaaaaaatggaaattaaagccctctattagcataaacggctacaggtctacctttacaatggcctttccttgtgcccagttcagaccctgtcattgccacgctactaaggactccctgaataccgtggccgacgtcagacattgtctgactgaatacatcctgtgggtttctcatagatggacccatagagaaactgcagggcctctctacaggcttctcatctctttcagaactgatgcaacggagctctttggtggtgagttgaaggattcacttccgtgggacaatatcgacaattgcgtggagatcattaaatgtttcatcagaaatgactccatgaaaaccgccgaagaacttcgtgcaatcattggactttgtactcaatcagctatcgtctctggaagagtcttcaacgataagtatatcgacatactacttatgctgcgaaagattctgaacgagaacgactatctcaccctcttggatcatatccgcactgctaaatactaa

SEQ ID NO: 20 - protein, 181 aa, vaccinia virus
MISLSFLIHNPLKKWKLKPSISINGYRSTFTMAFPCAQFRPCHCHATKDSLNTVADVRHCLTEYILWVSHRWTHRETAGPLYRLLISFRTDATELFGGELKDSLPWDNIDNCVEIIKCFIRNDSMKTAEELRAIIGLCTQSAIVSGRVFNDKYIDILLMLRKILNENDYLTLLDHIRTAKY

SEQ ID NO: 21 - DNA, 270 bp, vaccinia virus
  CDS (1)...(270)
atgtcgttagaatcatttatcataactacgtttaataataattcatcaacgaatatcgataacatgtgtcatttatacgttaaagtctgtccgtcttctctattgtttagactgtttgtagaatgctgtgatataaacaaactagtagaaggtacgactccgttacactgttatctaatgaatgaaggatttgaatcatctgttttaaaaaacctattaaaggagtatgtcatgacagtgatggtcacattccattacacaaatatttaa

SEQ ID NO: 22 - protein, 89 aa, vaccinia virus
MSLESFIITTFNNNSSTNIDNMCHLYVKVCPSSLLFRLFVECCDINKLVEGTTPLHCYLMNEGFESSVLKNLLKEYVMTVMVTFHYTNI

SEQ ID NO: 23 - DNA, 156 bp, vaccinia virus
  CDS (1)...(156)
atgaatttacagaaattatctctggctatatatcttactgcgacatgttcgtggtgttatgaaacatgcataagaaaaactgcgttgtatcatgacattcaattggagcatgtagaagacaataaagatagtgtagcgtcgctaccgtacaagtag

SEQ ID NO: 24 - protein, 51 aa, vaccinia virus
MNLQKLSLAIYLTATCSWCYETCIRKTALYHDIQLEHVEDNKDSVASLPYK

SEQ ID NO: 25 - DNA, 573 bp, vaccinia virus
  CDS (1)...(573)
atgatgatatacggattaatagcgtgtcttatattcgtgacttcatccatcgctagtccactttatattcccgttattccacccattacggaagataaatcgttcaatagtgtagaggtattagtttccttgtttagagatgaccaaaaagactatacggtaacttctcagttcaataactacactatcgataccaaagactggactatcggcgtactatccacacctgatggtttggatataccattgactaatataacttattggtcacggtttactataggtcgtgcattgttcaaatcagagtctgaggatattttccaaaagaaaatgagtattctaggtgtttctatagaatgtaagaagtcgtcgacattacttacttttttgaccgtgcgtaaaatgactcgagtatttaataaatttccagatatggcttattatcgaggagactgtttaaaagccgtttatgtaacaatgacttataaaaatactaaaactggagagactgattacacgtacctctctaatggggggttgcctgcatactatcgtaatggggtcgatggttga

SEQ ID NO: 26 - protein, 190 aa, vaccinia virus
MMIYGLIACLIFVTSSIASPLYIPVIPPITEDKSFNSVEVLVSLFRDDQKDYTVTSQFNNYTIDTKDWTIGVLSTPDGLDIPLTNITYWSRFTIGRALFKSESEDIFQKKMSILGVSIECKKSSTLLTFLTVRKMTRVFNKFPDMAYYRGDCLKAVYVTMTYKNTKTGETDYTYLSNGGLPAYYRNGVDG

SEQ ID NO: 27 - DNA, 1074 bp, vaccinia virus
  CDS (1)...(1074)
atggatatctttaaagaactaatcgtaaaacaccctgatgaaaatgttttgatttctccagtttccattttatctactttatctattctaaatcatggagcagctggttctacagctgaacaactatcaaaatatatagagaatatgaatgagaatacacccgatgataagaaggatgacaataatgacatggacgtagatattccgtattgtgcgacactagctaccgcaaataaaatatacggtagcgatagtatcgagttccatgcctccttcctacaaaaaataaaagacgattttcaaactgtaaactttaataatgctaaccaaacaaaggaactaatcaacgaatgggttaagacaatgacaaatggtaaaattaattccttattgactagtccgctatccattaatactcgtatgacagttgttagcgccgtccattttaaagcaatgtggaaatatccattttctaaacatcttacatatacagacaagttttatatttctaagaatatagttaccagcgttgatatgatggtgggtaccgagaataacttgcaatatgtacatattaatgaattattcggaggattctctattatcgatattccatacgagggaaactctagtatggtgattatactaccggacgacatagaaggtatatataacatagaaaaaaatataacagatgaaaaatttaaaaaatggtgtggtatgttatctactaaaagtatagacttgtatatgccaaagtttaaagtggaaatgacagaaccgtataatctggtacctattctagaaaatttaggacttactaatatattcggatattatgcagattttagcaagatgtgtaatgaaactatcactgtagaaaaatttctacatacgacgtttatagatgttaatgaggagtatacagaagcatcggccgttacaggagtatttatgactaacttttcgatggtatatcgtacgaaggtctacataaaccatccattcatgtacatgattaaagacaacacaggacgtatactttttatagggaaatactgctatccgcaataa

SEQ ID NO: 28 - protein, 357 aa, vaccinia virus
MDIFKELIVKHPDENVLISPVSILSTLSILNHGAAGSTAEQLSKYIENMNENTPDDKKDDNNDMDVDIPYCATLATANKIYGSDSIEFHASFLQKIKDDFQTVNFNNANQTKELINEWVKTMTNGKINSLLTSPLSINTRMTVVSAVHFKAMWKYPFSKHLTYTDKFYISKNIVTSVDMMVGTENNLQYVHINELFGGFSIIDIPYEGNSSMVIILPDDIEGIYNIEKNITDEKFKKWCGMLSTKSIDLYMPKFKVEMTEPYNLVPILENLGLTNIFGYYADFSKMCNETITVEKFLHTTFIDVNEEYTEASAVTGVFMTNFSMVYRTKVYINHPFMYMIKDNTGRILFIGKYCYPQ

SEQ ID NO: 29 - DNA, 420 bp, vaccinia virus
  CDS (1)...(420)
atgtcgatgaaatatctgatgttgttgttcgctgctatgataatcagatcattcgccgatagtggtaacgctatcgaaacgacattgccagaaattacaaacgctacaacagatattccagctatcagattatgcggtccagagggagatggatattgtttacacggtgactgtatccacgctagagatatcgacggtatgtattgtagatgctctcatggttatacaggcattagatgtcagcatgtagtattagtagactatcaacgttcagaaaaaccaaacactacaacgtcatatatcccatctcccggtattatgcttgtattagtaggcattattattatgtgttgtctattatctgtttataggttcactcgacgaactaaactacctctacaagatatggttgtgccataa

SEQ ID NO: 30 - protein, 139 aa, vaccinia virus
MSMKYLMLLFAAMIIRSFADSGNAIETTLPEITNATTDIPAIRLCGPEGDGYCLHGDCIHARDIDGMYCRCSHGYTGIRCQHVVLVDYQRSEKPNTTTSYIPSPGIMLVLVGIIIMCCLLSVYRFTRRTKLPLQDMVVP

SEQ ID NO: 31 - DNA, 996 bp, vaccinia virus
  CDS (1)...(996)
atggatatttacgacgataaaggtctacagactattaaactgtttaataatgaatttgattgtataaggaatgacatcagagaattatttaaacatgtaactgattccgatagtatacaacttccgatggaagacaattctgatattatagaaaatatcagaaaaatactatatagacgattaaaaaatgtagaatgtgttgacatcgataacacaataacttttatgaaatacgatccaaatgatgataataagcgtacgtgttctaattgggtacccttaactaataactatatggaatattgtctagtaatatatttggaaacaccgatatgtggaggcaaaataaaattataccaccctacaggaaatataaagtcggataaggatattatgtttgcaaagactctagactttaaatcaaagaaagtgttaactggacgtaagacaattgccgttctagacatatccgtttcatataatagatcaataactactattcactacaacgacgacgttgatatagatatacatactgataaaaatggaaaagagttatgttattgttatataacaatagatgatcattacttggttgatgtggaaactataggagttatagtcaatagatctggaaaatgtctgttagtaaataaccatctaggtataggtatcgttaaagataaacgtataagcgatagttttggagatgtatgtatggatacaatatttgacttttctgaagcacgagagttattttcattaactaatgatgataacagaaatatagcatgggacactgataaactagacgatgatacagatatatggactcccgtcacagaagatgattacaaatttctttctagactagtattgtatgcaaaatctcaatcggatactgtattcgactattatgttcttactggtgatacggaaccacccactgtattcattttcaaggtaactagattttactttaatatgctgaaataa

SEQ ID NO: 32 - protein, 331 aa, vaccinia virus
MDIYDDKGLQTIKLFNNEFDCIRNDIRELFKHVTDSDSIQLPMEDNSDIIENIRKILYRRLKNVECVDIDNTITFMKYDPNDDNKRTCSNWVPLTNNYMEYCLVIYLETPICGGKIKLYHPTGNIKSDKDIMFAKTLDFKSKKVLTGRKTIAVLDISVSYNRSITTIHYNDDVDIDIHTDKNGKELCYCYITIDDHYLVDVETIGVIVNRSGKCLLVNNHLGIGIVKDKRISDSFGDVCMDTIFDFSEARELFSLTNDDNRNIAWDTDKLDDDTDIWTPVTEDDYKFLSRLVLYAKSQSDTVFDYYVLTGDTEPPTVFIFKVTRFYFNMLK

SEQ ID NO: 33 - DNA, 252 bp, vaccinia virus
  CDS (1)...(252)
atgcattatccgaaatattatatcaatatcacaaaaataaatccacatttggctaatcaatttcgggcttggaaaaaacgtatcgccggaagggactatatgactaacttatctagagatacaggaatacaacaatcaaaacttactgaaactatacgtaactgtcaaaaaaatagaaacatatatggtctatatatacactacaatttagttattaattggataaccgatgtgattatcaatcaatattaa

SEQ ID NO: 34 - protein, 83 aa, vaccinia virus
MHYPKYYINITKINPHLANQFRAWKKRIAGRDYMTNLSRDTGIQQSKLTETIRNCQKNRNIYGLYIHYNLVINWITDVIINQY

SEQ ID NO: 35 - DNA, 189 bp, vaccinia virus
  CDS (1)...(189)
atgaagttgtttactcaaaacgatagatactttggtttattggattcgtgtaatcatatattttgcataacatgtatcaatatatggcataaaacacgaagagaaaccggtgcgtcggataattgtcctatatgtcgtacccgttttagaaacataacaatgagcaagttctataagctagttaactaa

SEQ ID NO: 36 - protein, 62 aa, vaccinia virus
MKLFTQNDRYFGLLDSCNHIFCITCINIWHKTRRETGASDNCPICRTRFRNITMSKFYKLVN

SEQ ID NO: 37 - DNA, 375 bp, vaccinia virus
  CDS (1)...(375)
atgagaatcctatttctcatcgccttcatgtatgggtgtgttcacccatatgttaatgccgacgaaatcaaatgtcctaacctaaacatcgtaacatcttctggagaatttcgttgcactggatgtgtgaaatttatgcctaattttagctacatgtattggttggcaaaggatatgagatcggacgaggataccaagtttatagaacatctgggtgatggcatcaaagaagatgaaaccgttcgtaccatagatggtagaatcgtcactctacagaaagtccttcatgtaaccgatactaataaatttgctcattataggttcacttgtgtcctcactacgatagatggcatttataaaaagaatgtttgctga

SEQ ID NO: 38 - protein, 124 aa, vaccinia virus
MRILFLIAFMYGCVHPYVNADEIKCPNLNIVTSSGEFRCTGCVKFMPNFSYMYWLAKDMRSDEDTKFIEHLGDGIKEDETVRTIDGRIVTLQKVLHVTDTNKFAHYRFTCVLTTIDGIYKKNVC

SEQ ID NO: 39 - DNA, 273 bp, vaccinia virus
  CDS (1)...(273)
atgaaaaaaataatggtaggtggtaatactatgttctcattaatatttactgatcatggagctaaaattattcatagatatgccaataatccagaattacgtgagtattatgagttaaaacaaaataaaatatatgtggaagcatatgatattatttccaacgcaatagtgaaacatgatagaatacataaaaccatagaatcagttgatgataatacctacatttctaatcttccgtataccatcaaatacaaaatattcgagcaacaataa

SEQ ID NO: 40 - protein, 90 aa, vaccinia virus
MKKIMVGGNTMFSLIFTDHGAKIIHRYANNPELREYYELKQNKIYVEAYDIISNAIVKHDRIHKTIESVDDNTYISNLPYTIKYKIFEQQ

SEQ ID NO: 41 - DNA, 429 bp, vaccinia virus
  CDS (1)...(429)
atgtcttatgcttgcccaattcttagtactataaacatttgcctaccttatcttaaagacattaacatgattgacaaacgaggagaaacacttcttcacaaggctgttagatataataaacaatctctagtatctttactgctagaatccggttcagatgtcaacattagatcaaataacggatatacatgtatagccattgccatcaacgaatctaaaaacattgaactgctgaaaatgctattatgtcataaacctacattagattatgtgattgattcattgagagaaatatctaacatcgtagataactactatgctataaaacaatgtattaaatatgccatgattatagatgactgtacatcgtctaagattccagagtccataagtcaacgctataatgattatatagatctttgcaattaa

SEQ ID NO: 42 - protein, 142 aa, vaccinia virus
MSYACPILSTINICLPYLKDINMIDKRGETLLHKAVRYNKQSLVSLLLESGSDVNIRSNNGYTCIAIAINESKNIELLKMLLCHKPTLDYVIDSLREISNIVDNYYAIKQCIKYAMIIDDCTSSKIPESISQRYNDYIDLCN

SEQ ID NO: 43 - DNA, 405 bp, vaccinia virus
  CDS (1)...(405)
atgaaaggaatagataacactgcttattcatatatagacgatctaacatgttgcactcgaggaattatggctgattatctaaatagtgattatagatacaataaagatgtagatttggtcaaattgtttttggagaatggaaagcctcacggaataatgtgtagtattgtaccactatggagaaatgataaggaaaccatctttttgatattgaaaacaatgaactcggatgtcctccaacatatactaattgagtatatgacattcggcgatatccctctagtggaatatggaactgtggtaaataaagaggctatacacggatactttagaaatattaatattgattcttacacgatgaaatatctactaaaaaaggaagggagatgccatcaattatctcga

SEQ ID NO: 44 - protein, 135 aa, vaccinia virus
MKGIDNTAYSYIDDLTCCTRGIMADYLNSDYRYNKDVDLVKLFLENGKPHGIMCSIVPLWRNDKETIFLILKTMNSDVLQHILIEYMTFGDIPLVEYGTVVNKEAIHGYFRNINIDSYTMKYLLKKEGRCHQLSR

SEQ ID NO: 45 - DNA, 234 bp, vaccinia virus
  CDS (1)...(234)
atgttaaagttaaaggatatagcgatggctctactagaagccactggatttagcaacataaatgactttaatatattcagctatatgaaatccaaaaatgtagacgttgacttgataaaggtgttggtagaacatggatttgacttgagtgttaaatgtgaaaaccatcgttcagttatagaaaattatgtaatgacaatgatcctgttcctaaaattattgatttgttcatag

SEQ ID NO: 46 - protein, 77 aa, vaccinia virus
MLKLKDIAMALLEATGFSNINDFNIFSYMKSKNVDVDLIKVLVEHGFDLSVKCENHRSVIENYVMTMILFLKLLICS

SEQ ID NO: 47 - DNA, 216 bp, vaccinia virus
  CDS (1)...(216)
atgtttgactatttggaaaatgaggaggtggctctcgatgaacttaaacagatgttgagagacagagatcctaatgataccaggaaccaattcaagaataatgctttacacgcatacctttttaatgagcattgtaataatgtcgaggtcgtcaaactactactagacagtggcactaatccattacgcaaaaattggagacagctaccccattag

SEQ ID NO: 48 - protein, 71 aa, vaccinia virus
MFDYLENEEVALDELKQMLRDRDPNDTRNQFKNNALHAYLFNEHCNNVEVVKLLLDSGTNPLRKNWRQLPH

SEQ ID NO: 49 - DNA, 165 bp, vaccinia virus
  CDS (1)...(165)
atgtcttctaaagggggtagtggcggcatgtggagtgtctttatccatggacatgatggtagtaataaaggatctaaaacttatacatctggtggcggtggaatgtggggaggaggatcgtccagtggggttaacggaggtgtaaaatctggaactggtaaaatt

SEQ ID NO: 50 - protein, 55 aa, vaccinia virus
MSSKGGSGGMWSVFIHGHDGSNKGSKTYTSGGGGMWGGGSSSGVNGGVKSGTGKI

SEQ ID NO: 51 - DNA, 1902 bp, vaccinia virus
  CDS (1)...(1902)
atggttaacgataagatactctatgatagttgtaaaacatttaacatcgatgccagcagtgcacaatcattgatagaaagtggtgcaaatccattatatgagtatgatggtgaaactccattaaaggcatacgttaccaagaaaaataataatatcaaaaacgatgttgtgattttgttattgtcgtcagtcgactataaaaatatcaatgattttgatatattcgaatatctatgttctgataacatcgatatagacttattgaaattactaatttcgaaaggtatagaaataaatagtatcaaaaatggtattaatattgtagaaaaatacgctacaacatcaaatcccaatgtagatgtgtttaaactattattggataaaggaatacctacatgtagcaacatacagtatggatacaagatcaaaatagaacagattagacgtgctggtgaatattataattgggatgatgaattagacgattacgattacgactacaccactgattatgatgatagaatgggtaaaacagttctctattattatattattactaggtcacaagatggttatgctacatctttggacgtgataaactatttaatttcacacgaaaaagagatgcgttattatacttatcgtgaacataccacactctattattatcttgacaaatgcgatattaaacgggaaatatttgacgcgttattcgatagtaactatagtggtcatgaactaatgaatattctatctaactatttacgtaaacagtttaggaagaaaaatcacaaaatcgataattatatagttgatcaactattattcgaccgtgatacgttttatattttagaattgtgtaatagtttacgtaataatatcctaatatccacaattcttaaaagatatacagattctatacaagatctattgttagaatatgtatcttatcatacagtatacatcaatgttattaaatgtatgattgatgaaggagctacattatatagatttaagcatataaataaatattttcaaaaatttggcaatagagatcctaaagttgtcgagtatattttaaaaaatggaaacttagttgtaaataatgacaatgatgataacctaataaatattatgccattattccctaccttctctatgcgtgagttggatgtgttatcgatactaaaactttgtaagccgtatattaatgatataaacaaaatagataaacatggatgtagtatactttatcattgtattaagtcgcatagtgtcagcctagtagaatggttaatagataatggcacagacattaatataataacaaaatatgggtttacatgtattactatttgtgttatactggcagataaatatattccagaaatagcagaattatatattaagatattggaaattattctgagtaaattaccaaccatcgaatgtattaagaaaacagttgattacctagacgatcacaggtacttattcataggtggtaataataaatcgttactgaaaatatgtatcaagtacttcatattagtcgattataagtacacatgtagcatgtatccatcatatatagaatttataaccgactgcgaaaaagaaattgcggatatgcgtcaaattaaaataaatggtacggacatgcttacagtgatgtacatgttaaataaacctacaaagaaacgatatgttaataatccgatatttacagattgggctaataagcaatataagttttataatcaaataatatataatgctaataagttaatagaacaaagtaagaaaatagacgacatgatagaggaggtatccattgacgataatcgtttatcaacactaccgttagaaattagacatttgattttctcgtacgcgttccta

SEQ ID NO: 52 - protein, 634 aa, vaccinia virus
MVNDKILYDSCKTFNIDASSAQSLIESGANPLYEYDGETPLKAYVTKKNNNIKNDVVILLLSSVDYKNINDFDIFEYLCSDNIDIDLLKLLISKGIEINSIKNGINIVEKYATTSNPNVDVFKLLLDKGIPTCSNIQYGYKIKIEQIRRAGEYYNWDDELDDYDYDYTTDYDDRMGKTVLYYYIITRSQDGYATSLDVINYLISHEKEMRYYTYREHTTLYYYLDKCDIKREIFDALFDSNYSGHELMNILSNYLRKQFRKKNHKIDNYIVDQLLFDRDTFYILELCNSLRNNILISTILKRYTDSIQDLLLEYVSYHTVYINVIKCMIDEGATLYRFKHINKYFQKFGNRDPKVVEYILKNGNLVVNNDNDDNLINIMPLFPTFSMRELDVLSILKLCKPYINDINKIDKHGCSILYHCIKSHSVSLVEWLIDNGTDINIITKYGFTCITICVILADKYIPEIAELYIKILEIILSKLPTIECIKKTVDYLDDHRYLFIGGNNKSLLKICIKYFILVDYKYTCSMYPSYIEFITDCEKEIADMRQIKINGTDMLTVMYMLNKPTKKRYVNNPIFTDWANKQYKFYNQIIYNANKLIEQSKKIDDMIEEVSIDDNRLSTLPLEIRHLIFSYAFL

SEQ ID NO: 53 - DNA, 534 bp, vaccinia virus
  CDS (1)...(534)
atgtccgcaattagatttattgcgtgtctatatctcatttccatcttcggaaattgtcatgaggatccatattatcaaccatttgataaattaaacattactctagatatatacacttatgaggatctagtaccatacaccgtagacaatgacacaacttctttcgttaagatatactttaaaaaattttggattactgttatgactaaatggtgtgctccgtttattgataccgttagcgtatacacatcgcatgataatctgaatatacaattttatagtagggacgaatatgatacacaaagcgaggataaaatttgtaccattgatgttaaagcacgatgcaaacatctaacaaaacgagaagttacagtacaacaagaagcctacagatattcattatcttctgacctatcgtgttttgattctatagatctagagattgatcttattgaaactaatagtactgacactacagtactgaaatcatatgagctcatgcttcccaaacgtgctaaatccatacataactga

SEQ ID NO: 54 - protein, 177 aa, vaccinia virus
MSAIRFIACLYLISIFGNCHEDPYYQPFDKLNITLDIYTYEDLVPYTVDNDTTSFVKIYFKKFWITVMTKWCAPFIDTVSVYTSHDNLNIQFYSRDEYDTQSEDKICTIDVKARCKHLTKREVTVQQEAYRYSLSSDLSCFDSIDLEIDLIETNSTDTTVLKSYELMLPKRAKSIHN

SEQ ID NO: 55 - DNA, 453 bp, vaccinia virus
  CDS (1)...(453)
atgggtatacagcacgaattcgacatcattattaatggagatatcgcgttgagaaatttacagttacataaaggggataactacggatgcaaactaaaaattatttcgaatgattacaagaaattaaagtttagattcattatacgcccagattggtcggaaatcgacgaggtcaaaggattaaccgtatttgcaaacaactatgcggtgaaagttaataaggtagatgacacgttctattacgtaatatatgaggctgtaatacatctgtataacaaaaaaacagagatattgatttattctgatgatgagaacgagctcttcaaacactattacccatacatcagtctaaatatgattagtaaaaagtataaagttaaagaagagaactactcatccccgtatatagaacatccgttaatcccgtatagagattatgagtccatggattaa

SEQ ID NO: 56 - protein, 150 aa, vaccinia virus
MGIQHEFDIIINGDIALRNLQLHKGDNYGCKLKIISNDYKKLKFRFIIRPDWSEIDEVKGLTVFANNYAVKVNKVDDTFYYVIYEAVIHLYNKKTEILIYSDDENELFKHYYPYISLNMISKKYKVKEENYSSPYIEHPLIPYRDYESMD

SEQ ID NO: 57 - DNA, 456 bp, vaccinia virus
  CDS (1)...(456)
atgaatgcgtataataaagccgattcgttttctttagagtctgattctatcaaagatgttatacacgattatatttgttggctcagtatgactgatgaaatgagaccatctatcggaaacgtctttaaagcgatggaaacgtttaagatagacgcggttagatattacgatggtaacatatacgatttagctaaagatataaatgcgatgtcattcgacagttttataagatctctacaaaatatctcttcaaagaaagataaactcactgtttatggaaccatgggactgctgtctattgtcgtagatattaacaaaggttgtgatatatccaatatcaagttcgctgccggaataatcattttaatggagtatatttttgatgacacagatctgtcgcatcttaaagtagcactctatcgtagaatacagagacgtgatgatgtagatagataa

SEQ ID NO: 58 - protein, 151 aa, vaccinia virus
MNAYNKADSFSLESDSIKDVIHDYICWLSMTDEMRPSIGNVFKAMETFKIDAVRYYDGNIYDLAKDINAMSFDSFIRSLQNISSKKDKLTVYGTMGLLSIVVDINKGCDISNIKFAAGIIILMEYIFDDTDLSHLKVALYRRIQRRDDVDR

SEQ ID NO: 59 - DNA, 612 bp, vaccinia virus
  CDS (1)...(612)
atggcgtatatgaacagatcagatctcgataaactaaaacacgaaaatatcttttctgggaatattatagaggacgccaaagagttcgtctttggatctagaaaaatatatactgattctgttgatgatctaatagaattatatagtttagccaaatatcttaacaacgaaaatcttaaagatgtagtgattgagagaatggattatgtgtgcaaatatatcggtaaagataattggagtactatatattcgttttataaagaaaatggtctacgtaatagttttctacgacaatacatcaacaataatatagaagagatatgtaacacagaccaatttctaaaattggatgtagattcagtatgtgatattctagacaacgatgagatcgtagtaactagagaatatactatcttaaacatggtattacgatggctagaaaataaaagagttaatatagacgactttactaaagttatgttcgttattcgatttaaatttataacatattctgaactcactaatgcgatagagaaaatagctccagaatacagacaatgcttacaggatctataccatatgaaaattacgcgtcctagacactttgataac

SEQ ID NO: 60 - protein, 204 aa, vaccinia virus
MAYMNRSDLDKLKHENIFSGNIIEDAKEFVFGSRKIYTDSVDDLIELYSLAKYLNNENLKDVVIERMDYVCKYIGKDNWSTIYSFYKENGLRNSFLRQYINNNIEEICNTDQFLKLDVDSVCDILDNDEIVVTREYTILNMVLRWLENKRVNIDDFTKVMFVIRFKFITYSELTNAIEKIAPEYRQCLQDLYHMKITRPRHFDN

SEQ ID NO: 61 - DNA, 189 bp, vaccinia virus
  CDS (1)...(189)
atggaaagtggtaataatacatggattcctaaaacagatgatgagtataagtttctatctaaattgatgaatattgcgaagtttaacaacaccaaatttgattactacgtgcttgttggagatacggatccgtgtactgtctttacgttcaaagtaacaaagtattacatcaatctcaattatgaatag

SEQ ID NO: 62 - protein, 62 aa, vaccinia virus
MESGNNTWIPKTDDEYKFLSKLMNIAKFNNTKFDYYVLVGDTDPCTVFTFKVTKYYINLNYE

SEQ ID NO: 63 - DNA, 408 bp, vaccinia virus
  CDS (1)...(408)
atgttttctaaatctcttaactttagattcgagaatgtaaagcgcgactataaattggttatgtgttctatatctttgacatacaagccatctatatgcagaatccaatacgataacaataaatatttagatattagcgacagtcaagaatgtaataatatatgttactgcgtcataactatggatccccaccacttgatagatttagaaaccatatgtgtcttggtcgataaatcaggaaagtgtttgctagtaaacgagttttatattagatttaggaaaaatcacatctacaatagctttaccgatctatgcatggattatatatttgaactaccgaatacaaaagaattattcactctgcgcaacgatgatggacgaaacatagcctgggataatggaaagtgg

SEQ ID NO: 64 - protein, 136 aa, vaccinia virus
MFSKSLNFRFENVKRDYKLVMCSISLTYKPSICRIQYDNNKYLDISDSQECNNICYCVITMDPHHLIDLETICVLVDKSGKCLLVNEFYIRFRKNHIYNSFTDLCMDYIFELPNTKELFTLRNDDGRNIAWDNGKW

SEQ ID NO: 65 - DNA, 177 bp, vaccinia virus
  CDS (1)...(177)
atggatactattaaaatatttaatcatggagagtttgatactattagaaatgaattggtcaacttgttaaaagttgtaaaatggaacaccattaattcaaatgtaacggtatcgtctaccgacacaataaatatatcagagagatattatacaaacagtttaaaaatgtacgaaata

SEQ ID NO: 66 - protein, 59 aa, vaccinia virus
MDTIKIFNHGEFDTIRNELVNLLKVVKWNTINSNVTVSSTDTINISERYYTNSLKMYEI

SEQ ID NO: 67 - DNA, 792 bp, vaccinia virus
  CDS (1)...(792)
atgaaggtggagagcgtgacgttcctgacattgttgggaataggatgcgttctatcatgctgtactattccgtcacgacccattaatatgaaatttaagaatagtgtggagactgatgctaatgctaattacaacataggagacactatagaatatctatgtctacctggatacagaaagcaaaaaatgggacctatatatgctaaatgtacaggtactggatggacactctttaatcaatgtattaaacggagatgcccatcgcctcgagatatcgataatggccaacttgatattggtggagtagactttggctctagtataacgtactcttgtaatagcggatatcatttgatcggtgaatctaaatcgtattgtgaattaggatctactggatctatggtatggaatcccgaggcacctatttgtgaatctgttaaatgccaatcccctccatctatatccaacggaagacataacggatacgaggatttttataccgatgggagcgttgtaacttatagttgcaatagtggatattcgttgattggtaactctggtgtcctgtgttcaggaggagaatggtccgatccacccacgtgtcagattgttaaatgtccacatcctacaatatcaaacggatacttgtctagcgggtttaaaagatcatactcatacaacgacaatgtagactttaagtgcaagtacggatataaactatctggttcctcatcatctacttgctctccaggaaatacatggcagccggaacttccaaaatgtgtacgctaa

SEQ ID NO: 68 - protein, 263 aa, vaccinia virus
MKVESVTFLTLLGIGCVLSCCTIPSRPINMKFKNSVETDANANYNIGDTIEYLCLPGYRKQKMGPIYAKCTGTGWTLFNQCIKRRCPSPRDIDNGQLDIGGVDFGSSITYSCNSGYHLIGESKSYCELGSTGSMVWNPEAPICESVKCQSPPSISNGRHNGYEDFYTDGSVVTYSCNSGYSLIGNSGVLCSGGEWSDPPTCQIVKCPHPTISNGYLSSGFKRSYSYNDNVDFKCKYGYKLSGSSSSTCSPGNTWQPELPKCVR

SEQ ID NO: 69 - DNA, 1521 bp, vaccinia virus
  CDS (1)...(1521)
atggaaagcgtgatattttctatcaatggggaaattatacaagtgaataaggaaattattacggcgtctccgtataatttttttaaacgcattcaggagcaccatataaatgatgaagtgattatattgaatggtataaactatcacgcgtttgaatcgctattagactatatgcgctggaagaagataaacatcaccataaacaatgtagaaatgatactagttgctgccgtaataattgatgttacgcctgtagtagatctatgtgtaaaaactatgattcataatattaattccacaaattgtataaggatgtttaacttttctaaaagatatggaattaaaaaactatataatgcgtcgatgtcagaaataatcaacaatattactgcggtgacatccgatccagaatttggaaaattatcaaaggatgaactgacaactatcttatcccacgaagacgttaacgtaaatcatgaggatgttacagctatgatattattaaagtggatacataaaaatccaaacgatgtagatatcatcaacattttacatcccaagtttatgactaatactatgcgcaatgctatatcattgttgggattaactatatccaaatctacaaagccagtgacacgaaatggtataaaacataatatagtagtcattaaaaactctgattatatatccacaataacccattactctcctagaacagaatattggacgatagtcggtaatacagatagacaattctataatgcaaatgttttacataattgtctatacattattggcggcatgattaacaatagacatgtttattccgtatcgcgggtagatcttaaaacgaaaaaatggaaaacggttactaatatgtcgtcgttaaaatcagaagttagtacttgtgttaacgatggaaagttatatgtaataggaggattagaattttctatttcaacgggtgtggcagaatatttgaaacacggcacttcgaaatggataagacttccaaacttaattactcctagatattcaggcgcgtcggtattcgtaaacgatgatatatatgtaatgggtggagtttataccacgtatgaaaaatatgtagtattaaacgatgtggaatgtttcactaaaaatcgttggataaaaaagtctcccatgcctagacatcatagtatagtttatgctgtagagtacgacggcgacatctatgtaattactggaattactcacgagactcgtaattatctatacaaatatatagttaaggaagacaaatggatagaattgtacatgtactttaaccatgtaggaaagatgttcgtgtgttcttgcggtgattatatcttaattatagcagatgcaaaatacgaatattatccaaaatcaaatacttggaatttgttcgatatgtcaactcgtaatatcgaatattatgatatgtttactaaagatgaaactcataagtcactgccatcgtttttgagcaactgtgaaaaacaatttctacaatag

SEQ ID NO: 70 - protein, 506 aa, vaccinia virus
MESVIFSINGEIIQVNKEIITASPYNFFKRIQEHHINDEVIILNGINYHAFESLLDYMRWKKINITINNVEMILVAAVIIDVTPVVDLCVKTMIHNINSTNCIRMFNFSKRYGIKKLYNASMSEIINNITAVTSDPEFGKLSKDELTTILSHEDVNVNHEDVTAMILLKWIHKNPNDVDIINILHPKFMTNTMRNAISLLGLTISKSTKPVTRNGIKHNIVVIKNSDYISTITHYSPRTEYWTIVGNTDRQFYNANVLHNCLYIIGGMINNRHVYSVSRVDLKTKKWKTVTNMSSLKSEVSTCVNDGKLYVIGGLEFSISTGVAEYLKHGTSKWIRLPNLITPRYSGASVFVNDDIYVMGGVYTTYEKYVVLNDVECFTKNRWIKKSPMPRHHSIVYAVEYDGDIYVITGITHETRNYLYKYIVKEDKWIELYMYFNHVGKMFVCSCGDYILIIADAKYEYYPKSNTWNLFDMSTRNIEYYDMFTKDETHKSLPSFLSNCEKQFLQ

SEQ ID NO: 71 - DNA, 675 bp, vaccinia virus
  CDS (1)...(675)
atggtgaaaaataataaaataagtaatagctgccgaatgataatgagtactaaccctaataatattttaatgagacatctcaaaaatcttacagatgatgaatttaaatgtattattcatcgatcatctgattttctttatttgtctgatcgtgactatactagtataaccaaagaaacattagttagtgagatcgtagaagaatatccggatgattgtaataaaatattagctattatatttttggtgttagataaagacatagatgtagatataaaaactaaactaaagcctaaacccgcagttagatttgccattctagacaagatgactgaggatattaaactaacggatctagtcagacattattttagatacatagaacaagatataccactaggtccgttgttcaaaaaaatagattcgtacagaacaagagccattaataagtattcgaaagagttaggattggctactgaatactttaataagtacgggcatttaatgttttatactctccctataccatataacagattcttttgtagaaattcgataggctttttagcggttctatcgcctacgataggacacgtaaaagcattttataaattcatagaatacgtttctatagatgatagacggaaatttaaaaaggaattaatgtcgaaatga

SEQ ID NO: 72 - protein, 224 aa, vaccinia virus
MVKNNKISNSCRMIMSTNPNNILMRHLKNLTDDEFKCIIHRSSDFLYLSDRDYTSITKETLVSEIVEEYPDDCNKILAIIFLVLDKDIDVDIKTKLKPKPAVRFAILDKMTEDIKLTDLVRHYFRYIEQDIPLGPLFKKIDSYRTRAINKYSKELGLATEYFNKYGHLMFYTLPIPYNRFFCRNSIGFLAVLSPTIGHVKAFYKFIEYVSIDDRRKFKKELMSK

SEQ ID NO: 73 - DNA, 354 bp, vaccinia virus
  CDS (1)...(354)
atgaggactctacttattagatatattctttggagaaatgacaacgatcaaacctattataatgatgattttaaaaagcttatgttgttggatgaattggtagatgacggcgatgtatgtacattgattaagaacatgagaatgacgctgtccgacggtccattgctagatagattgaatcaaccagttaataatatagaagacgctaagcgaatgatcgctattagtgccaaagtggctagagacattggtgaacgttcagaaattagatgggaagagtcattcaccatactctttaggatgattgaaacatattttgatgatctaatgattgatctatatggtgaaaaataa

SEQ ID NO: 74 - protein, 117 aa, vaccinia virus
MRTLLIRYILWRNDNDQTYYNDDFKKLMLLDELVDDGDVCTLIKNMRMTLSDGPLLDRLNQPVNNIEDAKRMIAISAKVARDIGERSEIRWEESFTILFRMIETYFDDLMIDLYGEK

SEQ ID NO: 75 - DNA, 528 bp, vaccinia virus
  CDS (1)...(528)
atgacgtcctctgcaatggataataatgaacctaaagtactagaaatggtatatgatgctacaattttacccgaaggtagtagcatggatccaaatatcattgattgtataaacagacacatcaatatgtgtatacaacgcacctatagttctagtataattgccattttggatagattcctaacaatgaacaaggatgaactaaacaatacacagtgtcatataattaaagaatttatgacatacgaacaaatggcgattgaccattatggaggatatgtgaacgctattctatatcaaattcgtaaaagacctaatcaacatcacaccattgatctgtttaaaaaaataaaaagaacccggtatgacacttttaaagtggatcccgtagaattcgtcaaaaaagttatcggatttgtatctatcttgaacaaatataaaccggtttatagttacgtcctgtacgagaacgtcctgtacgatgagttcaaatgtttcattaactacgtggaaactaagtatttctaa

SEQ ID NO: 76 - protein, 175 aa, vaccinia virus
MTSSAMDNNEPKVLEMVYDATILPEGSSMDPNIIDCINRHINMCIQRTYSSSIIAILDRFLTMNKDELNNTQCHIIKEFMTYEQMAIDHYGGYVNAILYQIRKRPNQHHTIDLFKKIKRTRYDTFKVDPVEFVKKVIGFVSILNKYKPVYSYVLYENVLYDEFKCFINYVETKYF

SEQ ID NO: 77 - DNA, 1407 bp, vaccinia virus
  CDS (1)...(1407)
atgatatttgttatagagagtaaattgttgcaaatatacagaaatagaaatagaaatattaatttttatactacaatggacaacattatgtcggccgagtattatctatctctttatgccaaatataatagtaaaaatttagatgtatttaggaatatgctacaagctatcgaaccttctggaaataattatcacattctacatgcgtattgtggaattaaaggactagatgaacgatttgtcgaagaacttcttcatagaggatactctccaaatgagacggatgatgatggaaattatccattgcatatagcttctaaaattaataataatagaatagtcgcgatgctgctgacgcacggcgcagatccaaacgcgtgtgataaacataataaaacacctctatattatctctcgggaacagatgatgaagtcatagagagaataaatttattggtacagtatggagccaagattaacaactcggttgatgaagaaggatgtggtccgttgttggcgtgtacagatccttcagaaagagtgtttaaaaaaataatgtccatcggattcgaagccaggatagtggataaatttggcaaaaatcatattcatagacatcttatgtcagacaatccaaaagcttctacaatctcatggatgatgaaactaggaattagtccctcaaaaccagatcatgatggaaatacacctctccatattgtatgctctaaaacagttaagtatgtagacattatagatcttttacttccatcaacggatgttaataaacaaaacaaattcggagatagtcctcttacacttcttattaagacattgagcctagcgcatcttattaacaaattgctatcgactagcaatgttattacggatcaaacagttaatatttgtatcttttatgatagagatgatgttctagaaattattaatgataaaggaaagcaatatgattttaagatggctgttgaagtgggatccataagatgcgtcaaatatctattagacaatgatataatttgtgaagatgctatgtactacgctgtactatctgaatacaaaacaatggtagactatctattgttcaatcattttagtgtagactctgtagttaacggtcatacatgtatgagcgaatgtgtaagactaaataacccagtcattttatcgaagctgatgttacataatcctacttctgagaccatgtatctaactatgaaagctatagaaaaagatagactagataaatctattattattccgtttatcgcgtactttgtacttatgcatccggacttttgtaaaaatcgtagatactttacttcatataaacgttttgtaactgattatgttcatgaaggagtatcttacgaagtattcgatgattatttt

SEQ ID NO: 78 - protein, 469 aa, vaccinia virus
MIFVIESKLLQIYRNRNRNINFYTTMDNIMSAEYYLSLYAKYNSKNLDVFRNMLQAIEPSGNNYHILHAYCGIKGLDERFVEELLHRGYSPNETDDDGNYPLHIASKINNNRIVAMLLTHGADPNACDKHNKTPLYYLSGTDDEVIERINLLVQYGAKINNSVDEEGCGPLLACTDPSERVFKKIMSIGFEARIVDKFGKNHIHRHLMSDNPKASTISWMMKLGISPSKPDHDGNTPLHIVCSKTVKYVDIIDLLLPSTDVNKQNKFGDSPLTLLIKTLSLAHLINKLLSTSNVITDQTVNICIFYDRDDVLEIINDKGKQYDFKMAVEVGSIRCVKYLLDNDIICEDAMYYAVLSEYKTMVDYLLFNHFSVDSVVNGHTCMSECVRLNNPVILSKLMLHNPTSETMYLTMKAIEKDRLDKSIIIPFIAYFVLMHPDFCKNRRYFTSYKRFVTDYVHEGVSYEVFDDYF

SEQ ID NO: 79 - DNA, 663 bp, vaccinia virus
  CDS (1)...(663)
atggtttacaaattagtcttgctcttttgtatcgcatctctcgggtattcggtagaatacaagaatactatatgtcctcctcgacaagattaccggtattggtactttgccgccgaactcactattggtgtaaattatgacattaattctactattattggtgagtgtcatatgagtgaaagctatatcgacagaaatgctaacatagtgttgactggatacggactagaaataaacatgaccatcatggatacggatcagagatttgtggcagcggctgagggtgttggtaaagataataaactatctgttctgttgtttaccactcagcggctagataaagttcatcacaatattagtgtgacaataacatgtatggaaatgaattgtggaaccacaaaatacgatagcgatcttccggaatcaattcataaatcatcatcgtgtgatataactataaatggatcatgtgtgacatgtgttaacttagagactgatccaacaaagattaatccccattacctacaccccaaggataaatatctttatcataattctgagtatggcatgcgtggtagttatggcgtgacatttatagatgaactaaaccagtgccttcttgacataaaagaactaagttatgatatttgttatagagagtaa

SEQ ID NO: 80 - protein, 220 aa, vaccinia virus
MVYKLVLLFCIASLGYSVEYKNTICPPRQDYRYWYFAAELTIGVNYDINSTIIGECHMSESYIDRNANIVLTGYGLEINMTIMDTDQRFVAAAEGVGKDNKLSVLLFTTQRLDKVHHNISVTITCMEMNCGTTKYDSDLPESIHKSSSCDITINGSCVTCVNLETDPTKINPHYLHPKDKYLYHNSEYGMRGSYGVTFIDELNQCLLDIKELSYDICYRE

SEQ ID NO: 81 - DNA, 852 bp, vaccinia virus
  CDS (1)...(852)
atggatctgtcacgaattaatacttggaagtctaagcagctgaaaagctttctctctagtaaagatacatttaaggcggatgtccatggacatagtgccttgtattatgcaatagctgataataacgtgcgtctagtatgtacgttgttgaacgctggagcattgaaaaatcttctagagaatgaatttccattacatcaggcagccacattggaagataccaaaatagtaaagattttgctattcagtggactggatgattcacaatttgatgacaagggaaacaccgcattgtattatgcggttgatagtggtaacatgcaaacggtaaaactgtttgttaagaaaaattggagactgatgttctatgggaaaactggatggaaaacttcattttatcatgccgtcatgcttaatgatgtaagtattgtttcctactttctttcagagataccatctacttttgatctggctattctccttagttgtattcacatcactataaaaaatggacacgtggatatgatgattctcttgctcgactatatgacgtcgacaaacaccaataattcccttctcttcattccggacattaaattggctatagataataaagacattgagatgttacaggctctgttcaaatacgacattaatatctattctgctaatctggaaaatgtactattggatgatgccgaaatagctaaaatgattatagaaaagcatgttgaatacaagtctgactcctatacaaaagatctcgatatagtcaagaataataaattggatgaaataattagcaaaaacaaggaactcagactcatgtacgtcaattgtgtaaagaaaaac

SEQ ID NO: 82 - protein, 284 aa, vaccinia virus
MDLSRINTWKSKQLKSFLSSKDTFKADVHGHSALYYAIADNNVRLVCTLLNAGALKNLLENEFPLHQAATLEDTKIVKILLFSGLDDSQFDDKGNTALYYAVDSGNMQTVKLFVKKNWRLMFYGKTGWKTSFYHAVMLNDVSIVSYFLSEIPSTFDLAILLSCIHITIKNGHVDMMILLLDYMTSTNTNNSLLFIPDIKLAIDNKDIEMLQALFKYDINIYSANLENVLLDDAEIAKMIIEKHVEYKSDSYTKDLDIVKNNKLDEIISKNKELRLMYVNCVKKN

SEQ ID NO: 83 - DNA, 1107 bp, vaccinia virus
  CDS (1)...(1107)
atgattgcgttattgatactatcgttaacgtgttcagtgtctacctatcgtctgcaaggatttaccaatgccggtatagtagcgtataaaaatattcaagatgataatattgtcttctcaccgtttggttattcgttttctatgtttatgtcgctattgcctgcatcaggtaatactagaatagaattattgaagactatggatttgagaaaaagagatctgggtccagcatttacagaattaatatcaggattagctaagctgaaaacatctaaatatacgtacactgatctaacttatcaaagtttcgtagataatactgtgtgtattaaaccgtcgtattatcaacaatatcatagattcggcctatatagattaaactttagacgagatgcggttaataaaattaattctatagtagaacgtagatccggtatgtctaatgtagtagattctaatatgctcgacaataatactctatgggcaatcattaatactatatattttaaaggtatatggcaatatccgtttgatatcactaaaacacgcaatgctagttttactaataagtacggtacgaaaacggttcccatgatgaacgtagttactaaattgcaaggaaatacaatcacaatcgatgacgaagaatatgatatggtgcgccttccgtataaggatgctaatattagtatgtacctggcaataggtgataatatgacccatttcacagattctattacggctgcaaaattagactattggtcgtttcaattagggaataaagtgtacaatcttaaactccctagattttctatcgaaaataagagggatattaagtcgatagccgaaatgatggctcctagtatgtttaatccagataatgcgtcgtttaaacatatgactagggacccattatatatttataaaatgtttcagaatgcaaagatagatgtcgacgaacaaggaactgtagcagaggcatctactatcatggtagctacggcgagatcatctcctgaaaaactggaatttaatacaccatttgtgttcatcatcagacatgatattactggatttatattgtttatgggtaaggtggaatctcct

SEQ ID NO: 84 - protein, 369 aa, vaccinia virus
MIALLILSLTCSVSTYRLQGFTNAGIVAYKNIQDDNIVFSPFGYSFSMFMSLLPASGNTRIELLKTMDLRKRDLGPAFTELISGLAKLKTSKYTYTDLTYQSFVDNTVCIKPSYYQQYHRFGLYRLNFRRDAVNKINSIVERRSGMSNVVDSNMLDNNTLWAIINTIYFKGIWQYPFDITKTRNASFTNKYGTKTVPMMNVVTKLQGNTITIDDEEYDMVRLPYKDANISMYLAIGDNMTHFTDSITAAKLDYWSFQLGNKVYNLKLPRFSIENKRDIKSIAEMMAPSMFNPDNASFKHMTRDPLYIYKMFQNAKIDVDEQGTVAEASTIMVATARSSPEKLEFNTPFVFIIRHDITGFILFMGKVESP

SEQ ID NO: 85 - DNA, 264 bp, vaccinia virus
  CDS (1)...(264)
atgcttgcattttgttattcgttgcccaatgcgggtgatgtaataaagggcagagtatacgagaatgattatgctctatatatttatctttttgactatcctcactttgaagctatcttggcggagagtgttaagatgcatatggatagatatgttgaatatagggataaactggtagggaaaactgtaaaagttaaagtgattagagttgattatacaaaaggatatatagatgtcaattacaaaaggatgtgtagacatcaa

SEQ ID NO: 86 - protein, 88 aa, vaccinia virus
MLAFCYSLPNAGDVIKGRVYENDYALYIYLFDYPHFEAILAESVKMHMDRYVEYRDKLVGKTVKVKVIRVDYTKGYIDVNYKRMCRHQ

SEQ ID NO: 87 - DNA, 1272 bp, vaccinia virus
  CDS (1)...(1272)
atgaatccggataatacaatcgcagtgattacagagactattcctataggtatgcaatttgataaagtatatttgtctacatttaacatgtggagggaaattctatccaataccacaaaaacactagatatatcatctttttattggagtttatcggatgaagtgggtacgaatttcggcacgataatattaaacgagattgtacaattacccaaaagaggagtaagagttagagtagccgtcaataaatctaacaaaccattaaaggatgttgaaagactacaaatggccggagttgaagtacgatacatagatattacaaatatcctaggaggagttcttcatacaaaattttggatatctgataatacacatatttatttaggaagcgctaacatggattggagatcactaactcaggtcaaagaattgggtattgcgatcttcaataataggaacttggcagcggatctcactcaaatttttgaggtatactggtatcttggagttaacaatctaccatataattggaaaaacttttatccgtcgtattataatacagatcatcctcttagtattaacgtaagtggtgttccacactctgtatttattgcttctgcaccgcaacaactatgtactatggaaagaaccaatgatttaaccgctttattgtcatgtattagaaatgcgagtaaattcgtttatgtatctgttatgaactttatccctattatttattcgaaggcgggtaaaattttgttttggccttatatagaagatgaattaagaagatccgctatagacagacaagtatccgttaagctattgattagttgctggcaacgatcttcgtttatcatgagaaactttttaagatctatcgctatgctaaaatctaaaaacatagatatagaagtaaagctatttattgtaccagatgctgatcctcccattccgtattctagggtaaaccatgccaaatatatggtaaccgataaaacggcctatataggtacctcaaattggacaggaaattactttacggatacatgtggagcatctattaatattacaccggatgatggattaggtcttcgtcaacaattggaagatatttttatgcgtgattggaattcaaaatacagctatgaattgtacgatactagtcctactaaaaggtgtaaactattaaaaaatatgaaacaatgtacaaatgatatatactgcgatgagatacaaccggaaaaagaaattcctgaatattctcttgaa

SEQ ID NO: 88 - protein, 424 aa, vaccinia virus
MNPDNTIAVITETIPIGMQFDKVYLSTFNMWREILSNTTKTLDISSFYWSLSDEVGTNFGTIILNEIVQLPKRGVRVRVAVNKSNKPLKDVERLQMAGVEVRYIDITNILGGVLHTKFWISDNTHIYLGSANMDWRSLTQVKELGIAIFNNRNLAADLTQIFEVYWYLGVNNLPYNWKNFYPSYYNTDHPLSINVSGVPHSVFIASAPQQLCTMERTNDLTALLSCIRNASKFVYVSVMNFIPIIYSKAGKILFWPYIEDELRRSAIDRQVSVKLLISCWQRSSFIMRNFLRSIAMLKSKNIDIEVKLFIVPDADPPIPYSRVNHAKYMVTDKTAYIGTSNWTGNYFTDTCGASINITPDDGLGLRQQLEDIFMRDWNSKYSYELYDTSPTKRCKLLKNMKQCTNDIYCDEIQPEKEIPEYSLE

SEQ ID NO: 89 - DNA, 411 bp, vaccinia virus
  CDS (1)...(411)
atgggagcaacaatttctatactagcctcttacgataatccaaacttgtttacagcaatgattctaatgtctcctctagttaatgcagatgctgtttcaaaactgaatctgctagctgccaaacttatgggaaccatcacaccaaatgcgccagtcggaaagctatgtccagaatcagtatctagagatatggataaagtttataaataccaatacgacccattaatcaatcatgaaaaaattaaggctggatttgctagtcaggtcttgaaggctaccaacaaggttagaaaaataatttccaagattaacaccccccgactctcatactccagggaacaaacaatgagattagtgatgtttcaggtgcatattatttcatgcaacatgcaaattgtaatagagaaataa

SEQ ID NO: 90 - protein, 136 aa, vaccinia virus
MGATISILASYDNPNLFTAMILMSPLVNADAVSKLNLLAAKLMGTITPNAPVGKLCPESVSRDMDKVYKYQYDPLINHEKIKAGFASQVLKATNKVRKIISKINTPRLSYSREQTMRLVMFQVHIISCNMQIVIEK

SEQ ID NO: 91 - DNA, 243 bp, vaccinia virus
  CDS (1)...(243)
atgagtgcaaactgtatgttcaatctggacaatgattacatatattggaaacctattacatatcctaaggcattagtattcataagtcatggagctggtaaacattctggacgttatgacgaactagctgaaaacatatcatcgttaggaattttagtattctcacatgatcatattggacatggaagaagtaatggtgaaaaaatgatgattgatgactttggtacagcacgtggtaactat

SEQ ID NO: 92 - protein, 81 aa, vaccinia virus
MSANCMFNLDNDYIYWKPITYPKALVFISHGAGKHSGRYDELAENISSLGILVFSHDHIGHGRSNGEKMMIDDFGTARGNY

SEQ ID NO: 93 - DNA, 450 bp, vaccinia virus
  CDS (1)...(450)
atggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtctattcgctaccataggaatatgtgctaaaatcactgaacattggggatacaaaaagatttcagaatctagattccaatcattgggaaacattacagatctgatgaccgacgataatataaacatcttgatactttttctagaaaaaaaattgaattga

SEQ ID NO: 94 - protein, 149 aa, vaccinia virus
MATKLDYEDAVFYFVDDDKICSRDSIIDLIDEYITWRNHVIVFNKDITSCGRLYKELMKFDDVAIRYYGIDKINEIVEAMSEGDHYINFTKVHDQESLFATIGICAKITEHWGYKKISESRFQSLGNITDLMTDDNINILILFLEKKLN

SEQ ID NO: 95 - DNA, 678 bp, vaccinia virus
  CDS (1)...(678)
atgttgtcgatgtttatgtgtaataatatcgtagattatgtagatgatatagataatggtatagtacatgatatagaagatgaggctagcaataatgttgatcacgactatgtatatccacttccagaaaatatggtatatagatttgacaagtccactaacatactcgattatctatcaacggaacgggaccatgtaatgatggctgttcgatactatatgagtaaacaacgtttagacgacttgtatagacagttgcccacaaagactagatcatatatagatattatcaacatatattgtgataaagttagtaatgattataatagggacatgaatatcatgtatgatatggcatctacaaaatcatttacagtttatgacataaataacgaagttaatactatactaatggataacaaggggttgggtgtaagattggcgacaatttcatttataaccaaattgggtagacgatgtatgaatccagtaaaaactataaaaatgtttactctactatcgcatactatatgcgatgattgttttgtagattatataacggacatttcaccaccagataataccatccctaacactagcacgcgtgaatatctaaagcttattggcatcacagctatcatgtttgctacatataaaactctcaaatacatgatagga

SEQ ID NO: 96 - protein, 226 aa, vaccinia virus
MLSMFMCNNIVDYVDDIDNGIVHDIEDEASNNVDHDYVYPLPENMVYRFDKSTNILDYLSTERDHVMMAVRYYMSKQRLDDLYRQLPTKTRSYIDIINIYCDKVSNDYNRDMNIMYDMASTKSFTVYDINNEVNTILMDNKGLGVRLATISFITKLGRRCMNPVKTIKMFTLLSHTICDDCFVDYITDISPPDNTIPNTSTREYLKLIGITAIMFATYKTLKYMIG

SEQ ID NO: 97 - DNA, 441 bp, vaccinia virus
  CDS (1)...(441)
atgttcaacatgaatattaactcaccagttagatttgttaaggaaactaacagagctaaatctcctactaggcaatcgccgggtgctgccggatatgatttgtatagcgcttacgattatactatccctccaggagaaagacagttaattaagacagatattagtatgtccatgcctaagatttgctatggtagaatagctcctaggtctggtctgtcactaaaaggcattgatataggaggtggtgtaatagacgaagattataggggaaacataggagtcattcttattaataatggaaaatgtacgtttaatgtaaatactggagatagaatagctcagctaatctatcaacgtatatattatccagaactggaagaagtacaatctctagatagtacaaatagaggagatcaagggtttggatcaacaggacttaga

SEQ ID NO: 98 - protein, 147 aa, vaccinia virus
MFNMNINSPVRFVKETNRAKSPTRQSPGAAGYDLYSAYDYTIPPGERQLIKTDISMSMPKICYGRIAPRSGLSLKGIDIGGGVIDEDYRGNIGVILINNGKCTFNVNTGDRIAQLIYQRIYYPELEEVQSLDSTNRGDQGFGSTGLR

SEQ ID NO: 99 - DNA, 1443 bp, vaccinia virus
  CDS (1)...(1443)
atgccgatatttgttaatactgtgtactgtaagaatatattagcattgtctatgactaagaaattcaaaacaattattgatgctataggtggcaatataatagtcaattctacgatattgaaaaagttatctccttactttcgcacacatttacgtcaaaaatacacgaaaaataaagatccagttacgagggtttgtctagaccttgacattcacagtttaacttctatagttatttactcgtatactggaaaggtatatatagatagtcataacgtcgtcaatttattacgtgcttctatattaacctctgtagaatttatcatctacacttgtataaactttatcttacgagattttagaaaggaatattgtgtcgagtgttacatgatgggtatagaatacggactatccaatctcttatgtcatactaaaaactttattgccaaacactttttggaactggaagatgacatcatagacaattttgattatctatctatgaaacttattctagaaagcgatgaactaaatgttccagatgaggattatgtagttgattttgtcattaagtggtatataaagcgaagaaatagattaggaaatctgctactccttatcaaaaatgtaatcaggtcaaattatctttctcccagaggtataaataatgtaaaatggatactagactgtaccaaaatatttcattgtgataaacaaccacgcaaatcatacaagtatccattcatagagtatcctatgaacatggatcaaattatagatatattccatatgtgtacaagtactcatgttggagaagtagtatatctcatcggtggatggatgaacaatgaaatacataacaatgctatagctgtaaattatatatcaaacaattggattccaattcctccgatgaatagccccagactgtatgctagcgggatacccgctaacaataaattatacgtagtaggaggtctaccaaatcccacatctgttgagcgttggttccacggggatgctgcttgggttaatatgccgagtcttctgaaacctagatgtaatccagcagtggcatccataaacaatgttatatacgtaatgggaggacattctgaaactgatacaactacagaatatttgctacccaatcatgatcagtggcagtttggaccatccacttattatcctcattataaatcatgcgcgttagtgttcggtagaaggttattcttggttggtagaaatgcggaattttattgtgaatccagcaatacatggactctgatagatgatcctatttatccgagggataatccagaattgatcatagtggataataaactgctattgataggaggattttatcgtgaatcgtatatagatactatagaagtgtacaatcatcacacttattcatggaatatatgggatggtaaataa

SEQ ID NO: 100 - protein, 480 aa, vaccinia virus
MPIFVNTVYCKNILALSMTKKFKTIIDAIGGNIIVNSTILKKLSPYFRTHLRQKYTKNKDPVTRVCLDLDIHSLTSIVIYSYTGKVYIDSHNVVNLLRASILTSVEFIIYTCINFILRDFRKEYCVECYMMGIEYGLSNLLCHTKNFIAKHFLELEDDIIDNFDYLSMKLILESDELNVPDEDYVVDFVIKWYIKRRNRLGNLLLLIKNVIRSNYLSPRGINNVKWILDCTKIFHCDKQPRKSYKYPFIEYPMNMDQIIDIFHMCTSTHVGEVVYLIGGWMNNEIHNNAIAVNYISNNWIPIPPMNSPRLYASGIPANNKLYVVGGLPNPTSVERWFHGDAAWVNMPSLLKPRCNPAVASINNVIYVMGGHSETDTTTEYLLPNHDQWQFGPSTYYPHYKSCALVFGRRLFLVGRNAEFYCESSNTWTLIDDPIYPRDNPELIIVDNKLLLIGGFYRESYIDTIEVYNHHTYSWNIWDGK

SEQ ID NO: 101 - DNA, 957 bp, vaccinia virus
  CDS (1)...(957)
atggaacccatccttgcaccaaatccaaatagatttgttattttcccaatccaatattatgacatctggaacatgtataaaaaggcagaggcatcattttggacagtggaagaagtagatatatctaaagatatcaatgattggaataaactaacaccagacgaaaaatattttataaaacatgtattggcgttttttgcagccagtgacggaatagtgaatgaaaatttggcggaacgattttgtacagaagtacagattaccgaggctagatgtttctacggatttcagatggccattgaaaacattcattcggaaatgtatagtcttttgatcgatacttatgttaaagatagtaatgaaaaaaactatctctttaatgccatagaaacgatgccttgtgtaaaaaagaaggccgattgggctcaaaagtggatacatgacagcgccggttatggagagagacttattgcctttgctgcagtagaaggaatcttcttttccggatcattcgcttccatattttggcttaaaaagcgtggcctaatgcccggactcacgttttccaacgaactaattagtagagacgagggtctgcactgcgatttcgcatgtttgatgtttaaacatttattgtatccaccgagtgaagaaaccgttagatatattataacagatgcagtatccattgaacaagaatttcttactgcggctcttccagttaaacttataggaatgaattgtgaaatgatgaaaacatatatagaattcgtcgcggatagattgatttctgaattgggatttaaaaaaatttataatgttaccaatccgtttgatttcatggaaaatatatcattggaaggaaaaactaattttttcgaaaaacgtgtgggtgaataccaaaaaatgggagttatgtctcaaaaagataatcatttttctctagatgttgacttt

SEQ ID NO: 102 - protein, 319 aa, vaccinia virus
MEPILAPNPNRFVIFPIQYYDIWNMYKKAEASFWTVEEVDISKDINDWNKLTPDEKYFIKHVLAFFAASDGIVNENLAERFCTEVQITEARCFYGFQMAIENIHSEMYSLLIDTYVKDSNEKNYLFNAIETMPCVKKKADWAQKWIHDSAGYGERLIAFAAVEGIFFSGSFASIFWLKKRGLMPGLTFSNELISRDEGLHCDFACLMFKHLLYPPSEETVRYIITDAVSIEQEFLTAALPVKLIGMNCEMMKTYIEFVADRLISELGFKKIYNVTNPFDFMENISLEGKTNFFEKRVGEYQKMGVMSQKDNHFSLDVDF

SEQ ID NO: 103 - DNA, 963 bp, vaccinia virus
  CDS (1)...(963)
atgggtacgaacggcgttagagtatttgtcattttatatttgttggctgtatgcggatgtatcgaatacgacgtagacgataatgtacatatttgtacccacactaacgtgtcacatattaatcacactagttggtattataatgataaggttatagcgctagccaccgaggataaaacttctggttatatatcatcattcataaaacgcgttaatatctcattaacttgtttaaatatatcgagtttgaggtacgaagattctggtacatacaaaggagtatcgcatctaaaagatggagtcatcgttacgactactatgaatatatctgtaaaggctaatatcattgacttgactggtagagtgcgttatctaaccagaaattattgcgaagttaaaatacgatgcgaaataacatctttcgcgcttaatggttctactacaccaccacatatgatattaggaacagtagataaatggaaatatcttccatttcctacagatgattatagatacgtaggggaactgaaaagatatatatctggaaacccatatccaacagagtcgctagcgttagaaattagctcgacgtttaatcggtttactatcgttaaaaatttgaacgatgacgagttttcttgttatctgttttcacaaaattatagtttccataaaatgttgaatgtgcgtaacatttgtgaatccaaatggaaggcgttaaataataatgataatgcatcctccatgcccgcttcccacaacaatctcgcaaacgatttatttagtatgatgtcacaattacaaaatgataatgatgataataacgattattcagcacccatgaatgtcgataatttaattatgatagtactaataacaatgctatcaataatacttgtaattattgtagtgattgcggcgatatcgatgtacaaaaaatccaagtacaggcatatagataac

SEQ ID NO: 104 - protein, 321 aa, vaccinia virus
MGTNGVRVFVILYLLAVCGCIEYDVDDNVHICTHTNVSHINHTSWYYNDKVIALATEDKTSGYISSFIKRVNISLTCLNISSLRYEDSGTYKGVSHLKDGVIVTTTMNISVKANIIDLTGRVRYLTRNYCEVKIRCEITSFALNGSTTPPHMILGTVDKWKYLPFPTDDYRYVGELKRYISGNPYPTESLALEISSTFNRFTIVKNLNDDEFSCYLFSQNYSFHKMLNVRNICESKWKALNNNDNASSMPASHNNLANDLFSMMSQLQNDNDDNNDYSAPMNVDNLIMIVLITMLSIILVIIVVIAAISMYKKSKYRHIDN

SEQ ID NO: 105 - DNA, 222 bp, vaccinia virus
  CDS (1)...(222)
atgagtaaaatactcacgtttgttaaaaataagataattgacttgattaataatgaccaaattaaatattctagagttataatgatagaagagtccgatagtcttttaccggttgatgaggtgcatgctaaccacggatttgactgtgtggagatgatagatgaaaatataagcaatgagaatatcgaacagtataaaaccgaatctttttttacaataaat

SEQ ID NO: 106 - protein, 74 aa, vaccinia virus
MSKILTFVKNKIIDLINNDQIKYSRVIMIEESDSLLPVDEVHANHGFDCVEMIDENISNENIEQYKTESFFTIN

SEQ ID NO: 107 - DNA, 240 bp, vaccinia virus
  CDS (1)...(240)
atgacgctcgtcatgggatcctgctgtggtagattctgtgacgctaagaataagaataagaaggaagatgtagaagagggaagagaaggatgttacaattataagaaccttaatgatctggatgaatccgaagcacgtgtagaatttggaccattatatatgataaatgaagaaaaatcagacataaatacattggatataaaaagaagatatagacacacgatagagtctgtatatttc

SEQ ID NO: 108 - protein, 80 aa, vaccinia virus
MTLVMGSCCGRFCDAKNKNKKEDVEEGREGCYNYKNLNDLDESEARVEFGPLYMINEEKSDINTLDIKRRYRHTIESVYF

SEQ ID NO: 109 - DNA, 195 bp, vaccinia virus
  CDS (1)...(195)
atggagggatctaaacgcagacacgacagtcggcgaccacaacaagaacaggagcagcctcgtccacgtacaccgccatcatatgaagaaattgcaaaatatggacactcatttaacgtgaaaagatttacgaataaagaaatgtgtcttaaaaatgattatccacgaattatatcatataatcctccaccaaaa

SEQ ID NO: 110 - protein, 65 aa, vaccinia virus
MEGSKRRHDSRRPQQEQEQPRPRTPPSYEEIAKYGHSFNVKRFTNKEMCLKNDYPRIISYNPPPK

SEQ ID NO: 111 - DNA, 636 bp, vaccinia virus
  CDS (1)...(636)
atggcggaaactaaagagtttaaaactttgtataatctttttatagatagttatttacaaaaattagctcaacattctatccctactaatgtcacttgtgctattcatataggagaggttataggacagtttaaaaattgcgcgctccgaataactaacaaatgcatgagtaattctcgacttagtttcacactcatggttgaatcatttattgaagtgatttcattgcttccggaaaaggatagaagagctatcgctgaggaaataggaatagatctagatgatgtacctagtgtagtatccaagctagaaaagaactgtaatgcgtatgcggaggttaataatattatagatatacagaaattggatatcggagaatgttcggctccgcccggccaacatatgcttttacagatagttaatacaggatccgcggaagcaaattgtggtttacagacaattgttaagtccttaaataaaatatacgttccacctattatcgaaaaccgattgccgtattacgatccgtggtttctagtgggtgtagcaattattctagttatttttactgtagctatttgttctattagacgaaatctggctcttaaatacagatacggaacgtttttatacgtt

SEQ ID NO: 112 - protein, 212 aa, vaccinia virus
MAETKEFKTLYNLFIDSYLQKLAQHSIPTNVTCAIHIGEVIGQFKNCALRITNKCMSNSRLSFTLMVESFIEVISLLPEKDRRAIAEEIGIDLDDVPSVVSKLEKNCNAYAEVNNIIDIQKLDIGECSAPPGQHMLLQIVNTGSAEANCGLQTIVKSLNKIYVPPIIENRLPYYDPWFLVGVAIILVIFTVAICSIRRNLALKYRYGTFLYV

SEQ ID NO: 113 - DNA, 1320 bp, vaccinia virus
  CDS (1)...(1320)
atgggtgttgccaatgattcatcccctgaatatcaatggatgtctccccatagattatcagatactgttatattaggagactgtttgtattttaacaatataatgtcccaattagatttacaccaaaattgggctccgtcagttagattgttaaattattttaagaattttaatagggaaacactactaaagatagaagagaatgattacattaattcatcctttttccaacaaaaggataaacgattttatcctataaacgacgatttttatcacatatctacaggaggatatggtatagtctttaagatagataactatgtagtaaaatttgtattcgaggccacaaaattatatagtcccatggaaactacggcggagttcacagtacccaaatttctatacaacaatctaaagggagatgaaaaaaaattaatcgtgtgtgcgtgggccatgggattaaactataaattaacatttttacatactctgtataaacgggttcttcatatgttgctattattgatacaaactatggatggtcaggaactctcattgagatattcttctaaagtttttttaaaggcgtttaacgagagaaaggacagtatcaaattcgtgaaattactatcccacttttacccggcagttattaacagtaatattaatgttataaactattttaaccgcatgtttcactttttcgaacatgaaaagagaactaactacgaatacgaaagaggaaatattataatttttcccctagcactgtattctgcagataaagtagataccgagttagctatcaaattaggatttaaatctttggtacaatacataaagtttatctttttacagatggctctgttatacattaaaatttacgaactaccatgctgcgacaactttttacacgcagatcttaaacccgataatatcttactttttgattccaatgaaccaataataattcatctaaaggataaaaagtttgtttttaatgaacgtattaaatcggcattaaacgactttgacttttcccaagtggctggaatcattaacaagaaaataaaaaacaatttcaaagttaaacataactggtattacgatttccatttctttgttcatactttattaaaaacatatccagaaatcgaaaaagatatcgaatttagtacagcattagaagaattcatcatgtgtaccaaaacagactgtgataaatatagattaaaggtttccattcttcacccaattagtttcttggaaaaatttattatgagagacattttctcagactggataaatggcggaaactaa

SEQ ID NO: 114 - protein, 439 aa, vaccinia virus
MGVANDSSPEYQWMSPHRLSDTVILGDCLYFNNIMSQLDLHQNWAPSVRLLNYFKNFNRETLLKIEENDYINSSFFQQKDKRFYPINDDFYHISTGGYGIVFKIDNYVVKFVFEATKLYSPMETTAEFTVPKFLYNNLKGDEKKLIVCAWAMGLNYKLTFLHTLYKRVLHMLLLLIQTMDGQELSLRYSSKVFLKAFNERKDSIKFVKLLSHFYPAVINSNINVINYFNRMFHFFEHEKRTNYEYERGNIIIFPLALYSADKVDTELAIKLGFKSLVQYIKFIFLQMALLYIKIYELPCCDNFLHADLKPDNILLFDSNEPIIIHLKDKKFVFNERIKSALNDFDFSQVAGIINKKIKNNFKVKHNWYYDFHFFVHTLLKTYPEIEKDIEFSTALEEFIMCTKTDCDKYRLKVSILHPISFLEKFIMRDIFSDWINGGN

SEQ ID NO: 115 - DNA, 1044 bp, vaccinia virus
  CDS (1)...(1044)
atggggttttgcattccattgagatcaaagatgttgaagagaggatctagaaaatcctcttccatactggctaggcgtcctactcctaaaaaaatgaacatagttactgatttggaaaatcgtttaaagaagaatagctatatagaaaatactaatcagggaaacattctgatggatagcatcttcgtatccactatgccggtagaaacattgtttggatcgtacataactgatgacagtgatgattatgaacttaaggatttactcaatgttacatataacattaaaccggtcatagttcctgacatcaagttagatgctgtattagatagagatggaaattttagaccagctgactgtttcttggttaaactgaaacatagagatggattcaccaaaggagctctctatcttggtcacagtgcaggatttacggcaacaatctgcttaaaaaatgagggggtttcagggctttacattccaggtacttctgtaattcggtccaatatctgtcaaggagatactatcgtcagtagatcatctagaggagttcaatttcttccacaaataggaggagaagctatcttcttgattgtttcactttgtcctaccaaaaagttagtagaaacaggattcgtcattccagaaatatcgtcaaatgataacgccaaaatcgctgctcgcattctatcagagaaacgcaaggacaccattgctcatattgacactctaatacaacacaggcaacaattggaattggcttactataattcctgcatgttaaccgagtttctgcattattgtaattcgtatgctggcaccatcaaagaatcacttctaaaagaaacaattcaaaaagatatcaatatcacacatacaaatattactaccctattgaatgagacagccaaggttatcaagttagtaaaatctctggtagataaagaagatactgatattgtgaataatttcattactaaagaaattaaaaacagagacaaaatagttaatagtttgtctctatcaaacctggactttcgtttg

SEQ ID NO: 116 - protein, 348 aa, vaccinia virus
MGFCIPLRSKMLKRGSRKSSSILARRPTPKKMNIVTDLENRLKKNSYIENTNQGNILMDSIFVSTMPVETLFGSYITDDSDDYELKDLLNVTYNIKPVIVPDIKLDAVLDRDGNFRPADCFLVKLKHRDGFTKGALYLGHSAGFTATICLKNEGVSGLYIPGTSVIRSNICQGDTIVSRSSRGVQFLPQIGGEAIFLIVSLCPTKKLVETGFVIPEISSNDNAKIAARILSEKRKDTIAHIDTLIQHRQQLELAYYNSCMLTEFLHYCNSYAGTIKESLLKETIQKDINITHTNITTLLNETAKVIKLVKSLVDKEDTDIVNNFITKEIKNRDKIVNSLSLSNLDFRL

SEQ ID NO: 117 - DNA, 1905 bp, vaccinia virus
  CDS (1)...(1905)
atgttaaacaggatacaaaccttgatgaaaacagctaacaattatgaaactattgagatattgcgtaattatttaagactgtatattattttggcacgaaatgaagaaggtcatggtatactaatatacgatgataacatagatagtattatgtcgatgatgaatattacaagattagaagttataggattgacgactcattgcacaaaattaagatcatcgcctccaattcctatgtctagattgtttatggacgaaatagatcatgagtcatattattctccaaaaacttcagattatccgttgatcgatattatacgaaagcgttcccacgaacagggagatatagcactggctttagaacaatacggtatcgagaatacagattccatatcagaaattaatgaatggttgtcgtcaaaaggtttagcatgttatagatttgtaaaatttaacgattacaggaaacagatgtatcgtaagttctctaggtgtactatagttgacagtatgataatagggcatataggtcatcattatatttggattaaaaatttagaaacatatacgcgtcccgaaattgatgtgttaccgtttgatattaaatacatatctagagatgaattgtgggcgcgaatttcttcctcgttagatcaaacacatataaaaaccatcgccgtatcagtttatggagctattactgataatggaccaataccatatatgatatccacgtacccgggtaatacctttgttaactttaacagtgtaaaagatctaattttatatttcttagattggattaaagatattatgactagtacacgaactatcattctagtaggttacatgagtaatctattcgatataccgttgctaacagtatactggcccaataactgtggatggaaaatctataataatacattaatatcatccgatggtgctagggttatttggatggatgcgtataaattttcttgcggtttatctttacaagactattgttatcattggggtagcaaaccagagagccgaccattcgatttaataaaaaaatcagatgctaaacgcaattctaaatcgttggtcaaagaatctatggcatccttgaaatccttgtacgaggcattcgagacacaatcaggagcgttagaagttttaatgagtccatgtaggatgttttcgttttctagaatagaagacatgttcttaactagtgtcattaatagagtatccgagaatactggaatggggatgtattatcctaccaacgatataccttttctatttatcgaatcatctatctgtctagattatattatagtaaataatcaggaatccaacaaatatcgtatcaaatctgttctcgatatcatttcttcaaaacaataccctgcaggacgtcccaactacgttaaaaatggtacaaaaggaaagttatatatcgcgttgtgtaaagttaccgtacctactaacgaccatattccagtagtttatcacgatgatgacaatactaccacctttattacagtattgacgtccgtcgatattgaaactgctatcagagcaggatattcgatagtcgaattaggggctttacaatgggatgataatattccagaacttaaagactgtttactggatagtatcaagatgatttatgacttgaacgcagtcacaacaaataatttattggaacagctcatagaaaatattaactttaacaactctagtataatttcgttgttctatacatttgccattagttattgccgagcattcatttactcaattatggaaaccatagatccggtgtatatatctcagttcagttataaagaattatacgttagtagctcttataaagatattaatgaatccatgagtcagatggtaaaatta

SEQ ID NO: 118 - protein, 635 aa, vaccinia virus
MLNRIQTLMKTANNYETIEILRNYLRLYIILARNEEGHGILIYDDNIDSIMSMMNITRLEVIGLTTHCTKLRSSPPIPMSRLFMDEIDHESYYSPKTSDYPLIDIIRKRSHEQGDIALALEQYGIENTDSISEINEWLSSKGLACYRFVKFNDYRKQMYRKFSRCTIVDSMIIGHIGHHYIWIKNLETYTRPEIDVLPFDIKYISRDELWARISSSLDQTHIKTIAVSVYGAITDNGPIPYMISTYPGNTFVNFNSVKDLILYFLDWIKDIMTSTRTIILVGYMSNLFDIPLLTVYWPNNCGWKIYNNTLISSDGARVIWMDAYKFSCGLSLQDYCYHWGSKPESRPFDLIKKSDAKRNSKSLVKESMASLKSLYEAFETQSGALEVLMSPCRMFSFSRIEDMFLTSVINRVSENTGMGMYYPTNDIPFLFIESSICLDYIIVNNQESNKYRIKSVLDIISSKQYPAGRPNYVKNGTKGKLYIALCKVTVPTNDHIPVVYHDDDNTTTFITVLTSVDIETAIRAGYSIVELGALQWDDNIPELKDCLLDSIKMIYDLNAVTTNNLLEQLIENINFNNSSIISLFYTFAISYCRAFIYSIMETIDPVYISQFSYKELYVSSSYKDINESMSQMVKL

SEQ ID NO: 119 - DNA, 1116 bp, vaccinia virus
  CDS (1)...(1116)
atgtggccatttgcatcggtacctgcgggagcaaaatgtaggctggtagaaacactaccagaaaatatggattttagatccgatcatttaacaacatttgaatgttttaacgaaattatcactctagctaagaaatatatatacatagcatctttttgttgtaatcctctgagtacgactaggggagcgcttatttttgataaactaaaagaggcatctgaaaaagggattaaaataatagttttgctagatgaacgagggaaaagaaatctgggagagctacaaagtcactgcccggatataaattttataaccgttaatatagataaaaaaaataatgtgggactactactcggttgtttttgggtgtcagatgatgaaagatgttatgtaggaaacgcgtcatttactggaggatctatacatacgattaaaacgttaggtgtatattctgattatcccccgctggccacagatcttcgtagaagatttgatacttttaaagcctttaatagcgcaaaaaattcatggttgaatttatgctctgcggcttgttgtttgccagttagcactgcgtatcatattaagaatcctataggtggagtgttctttactgattctccggaacacctattgggatattctagagatttagataccgatgtagttattgataaactcaggtcagctaagactagtatagatattgaacatttggccatagttcccactacacgtgtcgacggtaatagctactattggcccgacatttacaactccattatagaagcagccattaatagaggagttaagatcagacttctagttggtaattgggataagaacgacgtatattctatggcaaccgccagaagtctagacgcgttgtgtgttcaaaatgatctatctgtgaaggttttcactattcagaataatacaaaattgttgatagtcgacgacgaatatgttcatatcacttcggcaaatttcgacggaacccattaccaaaatcacggattcgtcagttttaatagtatagataaacagcttgtaagcgaggctaaaaaaatatttgagagagattgggtatctagccacagtaaatcgttaaaaatt

SEQ ID NO: 120 - protein, 372 aa, vaccinia virus
MWPFASVPAGAKCRLVETLPENMDFRSDHLTTFECFNEIITLAKKYIYIASFCCNPLSTTRGALIFDKLKEASEKGIKIIVLLDERGKRNLGELQSHCPDINFITVNIDKKNNVGLLLGCFWVSDDERCYVGNASFTGGSIHTIKTLGVYSDYPPLATDLRRRFDTFKAFNSAKNSWLNLCSAACCLPVSTAYHIKNPIGGVFFTDSPEHLLGYSRDLDTDVVIDKLRSAKTSIDIEHLAIVPTTRVDGNSYYWPDIYNSIIEAAINRGVKIRLLVGNWDKNDVYSMATARSLDALCVQNDLSVKVFTIQNNTKLLIVDDEYVHITSANFDGTHYQNHGFVSFNSIDKQLVSEAKKIFERDWVSSHSKSLKI

SEQ ID NO: 121 - DNA, 219 bp, vaccinia virus
  CDS (1)...(219)
atgaaacacagattgtattctgaaggattgagtattagtaatgatttaaactcgataatcggtcaacaatctacaatggatacggatatagaaataaacgaagatgacatcatggaacttcttaatatattgactgagttaggttgtgatgtcgactttgatgaaaattttagcgatatagccgatgatattctagaatcgttgatagaacaggatgta

SEQ ID NO: 122 - protein, 73 aa, vaccinia virus
MKHRLYSEGLSISNDLNSIIGQQSTMDTDIEINEDDIMELLNILTELGCDVDFDENFSDIADDILESLIEQDV

SEQ ID NO: 123 - DNA, 474 bp, vaccinia virus
  CDS (1)...(474)
atgaggagtattgcggggctacataaattaaaaatggaaatttttaatgtagaagaattgataaatatgaaaccttttaagaatatgaataaaataacaattaatcaaaaggataattgtatattagcaaatcgatgctttgttaaaatagatactcctagatacataccatcgacatccattagcagttctaatatcatcagaatacggaatcatgattttacattatctgaattattgtattcaccgtttcattttcaacagcctcagtttcaatatctccttcctgggtttgtattaacgtgtattgataaagtttcgaaacagcaaaaaaaatgtaaatattgtatctctaatcgtggaaatgatgatagtttaagcattaatctatttattccgactattaacaagtctatatatattattatcggtttacggatgaaaaatttttggaagcctaaattcgaaatagaa

SEQ ID NO: 124 - protein, 158 aa, vaccinia virus
MRSIAGLHKLKMEIFNVEELINMKPFKNMNKITINQKDNCILANRCFVKIDTPRYIPSTSISSSNIIRIRNHDFTLSELLYSPFHFQQPQFQYLLPGFVLTCIDKVSKQQKKCKYCISNRGNDDSLSINLFIPTINKSIYIIIGLRMKNFWKPKFEIE

SEQ ID NO: 125 - DNA, 693 bp, vaccinia virus
  CDS (1)...(693)
atgaaagtggtgattgtgactagtgtagcatcgcttctagacgcatctattcagtttcaaaaaacggcatgtaggcatcactgtaattacctatctatgcaagtagttaaagagatagaagaatttggtactatcaatgaaaaaaatttggaatttgacacttggaaagacgttatacaaaacgatgaaatagatgcattagtattttatagagtaaaacaaattagtatttctacgggtgttctatataaatctatgatgcgcaatagaacaaaacctatttccatgtactttgtacgtgattgtttggcatttgatggagatcctccgtcttttagaatgacgtcttgcaatatcaacgcatacaatcgtagtaagattaaagatttgataatcctaatgaatatgaaaacatgtaataaaaaaattatcggtgagtttataatagacaattttggaagcgttgatgcattactatcgataattaattctaatgttacgtgggttacatcagttataaataatagtaacggcaggggtattaatatcagggtatcaaataataaaatgttaactataactagttttcgacgatttgtcaataaacttaaaatgtacaaaactactaaatgcgcttctcaattggataatctatgtaccgagatgaacaaaatggatattatagacaaaaaa

SEQ ID NO: 126 - protein, 231 aa, vaccinia virus
MKVVIVTSVASLLDASIQFQKTACRHHCNYLSMQVVKEIEEFGTINEKNLEFDTWKDVIQNDEIDALVFYRVKQISISTGVLYKSMMRNRTKPISMYFVRDCLAFDGDPPSFRMTSCNINAYNRSKIKDLIILMNMKTCNKKIIGEFIIDNFGSVDALLSIINSNVTWVTSVINNSNGRGINIRVSNNKMLTITSFRRFVNKLKMYKTTKCASQLDNLCTEMNKMDIIDKK

SEQ ID NO: 127 - DNA, 306 bp, vaccinia virus
  CDS (1)...(306)
atgaattctcattttgcatctgctcatactccgttttatatcaataccaaagaaggaagatatctggttctaaaagccgttaaagtatgcgatgttagaactgtagaatgcgaaggaagtaaagcttcctgcgtactcaaagtagataaaccctcatcacccgcgtgtgagagaagaccttcgtccccgtccagatgcgagagaatgaataaccctggaaaacaagtcccgtttatgagaacggacatgctacaaaatatgttcgcggctaatcgcgacaacgtggcgtcgagacttttgaactaa

SEQ ID NO: 128 - protein, 101 aa, vaccinia virus
MNSHFASAHTPFYINTKEGRYLVLKAVKVCDVRTVECEGSKASCVLKVDKPSSPACERRPSSPSRCERMNNPGKQVPFMRTDMLQNMFAANRDNVASRLLN

SEQ ID NO: 129 - DNA, 1437 bp, vaccinia virus
  CDS (1)...(1437)
atgaataggaatcctgatcagaatacttttcctaatattacattaaagattatagaaacctatttaggcagagtacctagtgtgaacgaatatcatatgttaaaattacaagctagaaatattcagaaaataactgtttttaacaaagacatatttgtatctttagtaaaaaagaataaaaaaagatttttttccgatgttgatacatctgcatcagaaataaaagatcgtatacttagctacttttctaaacagactcaaacatataatataggtaaattatttacgattatagaactacaatctgtattagtgaccacatacacggacatattaggagttcttactattaaagctccaaatgtaatttcatctaaaatttcttataatgtaacatcaatggaagaattggcaagagatatgctaaattctatgaacgtcgcagtaatagacaaggcaaaagtaatgggacgtcataatgtatcttccctagtcaaaaatgttaataagttgatggaagaatatcttagacgccataataaaagttgtatatgttacggatcatattctctatatctaattaatccaaatatactatacggcgatatagatattcttcagactaattctaggacttttcttatagatttggcctttctaataaaatttatcacgggaaataatattatattaagtaaaatcccatatcttagaaactatatggtgataaaagatgaaaacgataatcatatcattgatagttttaatattcgccaggataccatgaacgtagttcctaaaatctttatagataatatctatatagtggatccgacgtttcaactattgaacatgataaaaatgttttctcaaatagatagattggaagatctatccaaagatcctgaaaagtttaatgcgcgtatggcaaccatgctagaatacgttagatatacacatggtatagtctttgatggtaagcgtaataatatgccgatgaaatgtatcatcgatgaaaataatcgcatagttactgtcactactaaagactattttagctttaaaaaatgtctagtgtatctagatgaaaatgtgttatcgagtgatatattagatcttaacgccgacacatcgtgtgatttcgagagtgttacaaattctgtatatctaattcatgataatatcatgtatacatatttctcaaatactattctccttagtgataaggggaaggtacatgaaataagtgccagaggtttatgtgcacatatattgttgtatcagatgctgacatctggagaatacaaacaatgtttatcggatctcttaaattcgatgatgaatagagataaaatacctatctattcacatactgaaagagataaaaaacccgggcgacacggatttattaatatcgaaaaagatataattgtattt

SEQ ID NO: 130 - protein, 479 aa, vaccinia virus
MNRNPDQNTFPNITLKIIETYLGRVPSVNEYHMLKLQARNIQKITVFNKDIFVSLVKKNKKRFFSDVDTSASEIKDRILSYFSKQTQTYNIGKLFTIIELQSVLVTTYTDILGVLTIKAPNVISSKISYNVTSMEELARDMLNSMNVAVIDKAKVMGRHNVSSLVKNVNKLMEEYLRRHNKSCICYGSYSLYLINPNILYGDIDILQTNSRTFLIDLAFLIKFITGNNIILSKIPYLRNYMVIKDENDNHIIDSFNIRQDTMNVVPKIFIDNIYIVDPTFQLLNMIKMFSQIDRLEDLSKDPEKFNARMATMLEYVRYTHGIVFDGKRNNMPMKCIIDENNRIVTVTTKDYFSFKKCLVYLDENVLSSDILDLNADTSCDFESVTNSVYLIHDNIMYTYFSNTILLSDKGKVHEISARGLCAHILLYQMLTSGEYKQCLSDLLNSMMNRDKIPIYSHTERDKKPGRHGFINIEKDIIVF

SEQ ID NO: 131 - DNA, 2214 bp, vaccinia virus
  CDS (1)...(2214)
atgatatctgtgacagatattcgtagagcgtttctagataatgaatgtcatactatcacaaaagcgtttggatatttgcacgaggacaatgcgatagcattaattaaaataggatttcatcccacttatctacccaaagtcctttataataatgttgtagaattcgttccagaaaaactatatctgtttaagccaagaactgtagctccattggatttgatatctactataacaaaattaaagaacgtggacaaatttgcctcacacataaattatcacaagaatagtatattgataacaggagacaagtctctaattgttaaatgtatgccttacatgattatttcagatgatgatatacgattcataagagaacagtttgttggtacaaattctattgagtatatcctatccttcatcaacaaggaaagcatatataaaatgagttaccaattttcagagaacgaaatagtcactatcatcaatagagatcatttcatgtatgaaccaatatatgaacatcaagtcttagattctgactttcttaaaactatgttagatagatacggaatagttcccattaattctggtataatagatgaattatgtccagaagctataatagagatattaatggcagtagttcgtcctagggacgctatccgtttcttagatatagtgaataagaatcaattgacagaagatagtgtcaaaaactatatcattaatgatatcagaagaggtaaaatagattattatattccatacgttgaagattttttagaagatagaactgaagacttgggaatatatgcgaatatattttttgaggatgctatagatattacgaaactagacatcacaaagacagagttggaacatatatcaaaatacatgaattattacactacttatatagatcacatagttaacatcatcttacaaaataattatatagatatcttggcatctataatagattacgtgcaagacgtattaacagaagaattatgtattagaatagtttgcgaatcaacaaaccctgttcccgttacatctcttcctatacattctacgttagtaatggttatgtgtatacaaatgaaatatgtcgatatagttgaattcttagacgagatcgatatcgatactttaatagaaaaaggagcagatccgataaccgaatacacatttacaacaagatggtacaataaacacaatgatttgatcactctttacattaagaaatatggattctgtccaatgatgatgaaacggttaatgttcgaatatccattgactaaagaagccagtgatcatttacttaaaaccatggatgaaaacaggggagctattatgttttttccgcgtactatttgcacacttccttatctattatgttgtaattataaactaattcaaaaacctattccattcaaagaagaaaatcgtaacatcgtatataagaaaaacaacagagtattatgctttgactcgttggagaactctgcgtttaaaagcctcattaaaatagattctattccaggattaaaaacttataacatgaaagacattacatacgaaaagtctaataatataatttgtgttaggtttatacctcaagaatcaattcataatgaagagcgaagaataaaattacagttattcgacattgctagattggcatcctatggactatattatattccctctagatatttatcatcgtggacaccagtagtgaacatgatagagggaagagagtacactaatccacaaaaaatagaatgtctagttattttggatttattttcagaggaattcatagaatatcaaaatctgggcaatgcggtatctaataaatatgaactggaatatactatatctaattatcaagctgccataaactgcctaatgagcacgttattaatatatctagttctaggatcaatcagatcgatatcaaaaactgaagattttgtattatctatattaaatatcttctataaaggactgaaaattaatgaattactttctgaaccagtatcaggagtttgtatcgaattagataaaataaaagatagagcgagctctggagacagtagttttatatttcttaagaaaaacgagttatcaaaaactctatcgctctgtgaaaaagtttgcgtagagaccatattagacaataatcagagttttaaatcctcaaaatga

SEQ ID NO: 132 - protein, 737 aa, vaccinia virus
MISVTDIRRAFLDNECHTITKAFGYLHEDNAIALIKIGFHPTYLPKVLYNNVVEFVPEKLYLFKPRTVAPLDLISTITKLKNVDKFASHINYHKNSILITGDKSLIVKCMPYMIISDDDIRFIREQFVGTNSIEYILSFINKESIYKMSYQFSENEIVTIINRDHFMYEPIYEHQVLDSDFLKTMLDRYGIVPINSGIIDELCPEAIIEILMAVVRPRDAIRFLDIVNKNQLTEDSVKNYIINDIRRGKIDYYIPYVEDFLEDRTEDLGIYANIFFEDAIDITKLDITKTELEHISKYMNYYTTYIDHIVNIILQNNYIDILASIIDYVQDVLTEELCIRIVCESTNPVPVTSLPIHSTLVMVMCIQMKYVDIVEFLDEIDIDTLIEKGADPITEYTFTTRWYNKHNDLITLYIKKYGFCPMMMKRLMFEYPLTKEASDHLLKTMDENRGAIMFFPRTICTLPYLLCCNYKLIQKPIPFKEENRNIVYKKNNRVLCFDSLENSAFKSLIKIDSIPGLKTYNMKDITYEKSNNIICVRFIPQESIHNEERRIKLQLFDIARLASYGLYYIPSRYLSSWTPVVNMIEGREYTNPQKIECLVILDLFSEEFIEYQNLGNAVSNKYELEYTISNYQAAINCLMSTLLIYLVLGSIRSISKTEDFVLSILNIFYKGLKINELLSEPVSGVCIELDKIKDRASSGDSSFIFLKKNELSKTLSLCEKVCVETILDNNQSFKSSK

SEQ ID NO: 133 - DNA, 570 bp, vaccinia virus
  CDS (1)...(570)
atgtctaagatctatattgacgagcgttctgacgcagagattgtgtgtgcggctattaaaaacattggaatcgaaggagctactgctgcacaactaactagacaacttaatatggagaagcgagaagttaataaagctctgtacgatcttcaacgtagtgctatggtgtacagctccgacgatattcctcctcgttggtttatgacaacggaggcggataagccggatgctgatgttatggctgacgccataatagatgatgtatcccgcgaaaaatcaatgagagaggatcataagtcttttgatgatgttattccggctaaaaaaattattgattggaaagatgctaaccctgtcaccattattaatgagtactgccaaataactaagagagattggtcttttcgtattgaatcagttgggcctagtaactctcctacattttatgcctgtgtagatatcgacggaagagtattcgataaggccgatggaaaatctaaacgagatgctaaaaataatgcagctaaattggctgtagataaacttcttgggtacgtcatcattagattc

SEQ ID NO: 134 - protein, 190 aa, vaccinia virus
MSKIYIDERSDAEIVCAAIKNIGIEGATAAQLTRQLNMEKREVNKALYDLQRSAMVYSSDDIPPRWFMTTEADKPDADVMADAIIDDVSREKSMREDHKSFDDVIPAKKIIDWKDANPVTIINEYCQITKRDWSFRIESVGPSNSPTFYACVDIDGRVFDKADGKSKRDAKNNAAKLAVDKLLGYVIIRF

SEQ ID NO: 135 - DNA, 777 bp, vaccinia virus
  CDS (1)...(777)
atggaaaatgtatacattagtagttactcatccaatgaacaaacatcaatggcggtagccgctactgatatccgagaattactatcacaatatgtggatgatgccaacttggaagacttaatagaatgggccatggaaaaatcatcaaagtactacatcaagaatataggtaatacaaaatctaatatcgaagaaactaaattcgaatcaaagaataatattggtatagaatactcaaaggattccagaaacaaactatcgtatagaaataaaccgtctattgccacaaatttggaatataaaacactatgtgatatgattaagggtactagcggcaccgaaaaagaattccttcgctatctcttattcggtataaaatgcattaagaaaggagtagaatacaatatagataaaataaaggatgtgagttacaacgattattttaacgttctcgacgagaaatacaatacaccgtgtcctaactgtaaaagtaggaatactacgccgatgatgattcaaactagagccgctgacgaacctccactagttagacatgcgtgtagagattgcaaacaacactttaagcctcccaaatttagagcatttcgcaatcttaatgttacaacgcaatcgatacatgaaaacaaggaaataacagagattcttccagataataatccatctcctccagaatctccagaaccagcatcacctatagatgacgggttaatcagatccacattcgataggaacgacgaaccaccagaggatgatgaa

SEQ ID NO: 136 - protein, 259 aa, vaccinia virus
MENVYISSYSSNEQTSMAVAATDIRELLSQYVDDANLEDLIEWAMEKSSKYYIKNIGNTKSNIEETKFESKNNIGIEYSKDSRNKLSYRNKPSIATNLEYKTLCDMIKGTSGTEKEFLRYLLFGIKCIKKGVEYNIDKIKDVSYNDYFNVLDEKYNTPCPNCKSRNTTPMMIQTRAADEPPLVRHACRDCKQHFKPPKFRAFRNLNVTTQSIHENKEITEILPDNNPSPPESPEPASPIDDGLIRSTFDRNDEPPEDDE

SEQ ID NO: 137 - DNA, 570 bp, vaccinia virus
  CDS (1)...(570)
atgttaataattgtattgtggttatacggctacaatttcataatgagtggaagtcagtgtccgatgatcaatgacgatagctttactctgaaaagaaagtatcaaatcgatagtgcggagtcaacaatgaaaatggataagaagaggacaaagtttcagaatagagccaaaatggtaaaagaaataaatcagacaataagagcagcacaaactcattacgagacattgaaactaggatacataaaatttaagagaatgattatgactactactctagaagatatagcaccatctattccaaataatcagaaaacttataaactattctcggacatttcagccatcggcaaagcatcacggaatccaagtaagatggtatatgctctgctgctttacatgtttcccaatttgtttggagatgaccatagattcattcgttatagaatgcatccaatgagtaaaatcaaacacaagatcttctctcctttcaaacttaatcttattagaatattagtggaagaaagattctataataatgaatgcagatctaataaatggaacacaagttga

SEQ ID NO: 138 - protein, 189 aa, vaccinia virus
MLIIVLWLYGYNFIMSGSQCPMINDDSFTLKRKYQIDSAESTMKMDKKRTKFQNRAKMVKEINQTIRAAQTHYETLKLGYIKFKRMIMTTTLEDIAPSIPNNQKTYKLFSDISAIGKASRNPSKMVYALLLYMFPNLFGDDHRFIRYRMHPMSKIKHKIFSPFKLNLIRILVEERFYNNECRSNKWNTS

SEQ ID NO: 139 - DNA, 450 bp, vaccinia virus
  CDS (1)...(450)
atgaatgcagatctaataaatggaacacaagttgataaaatgttgatagctgaatctgataaatatacaatagatgcaaggtataacctaaaacccatgtatagaatcaagggagaatctgaagaagataccctcttcatcaaacagatggtagaacaatgtgtgacatcccaggaattggtggaaaaagtgttgaagatactgtttagagatttgttcaagagtggagaatacaaagcatacagatacgatgatgatgtagaaaatggatttattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaatag

SEQ ID NO: 140 - protein, 149 aa, vaccinia virus
MNADLINGTQVDKMLIAESDKYTIDARYNLKPMYRIKGESEEDTLFIKQMVEQCVTSQELVEKVLKILFRDLFKSGEYKAYRYDDDVENGFIGLDTLKLNIVHDIVEPCMPVRRPVAKILCKEMVNKYFENPLHIIGKNLQECIDFVSE

SEQ ID NO: 141 - DNA, 1704 bp, vaccinia virus
  CDS (1)...(1704)
atggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcttacctaagcaagaaagatacaggcatagagtttgcggataatgatagacaagatatatacactctatttcaacaaactggtagaatagtccatagcaatctaacagaaacgtttagagattatatctttcccggagataagactagctattgggtgtggttaaacgaaagtatagctaatgatgcggatattgttcttaatagacacgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgataaaacgtttaacgaggacttattcagagttgttgttcaaataaatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttgagagataatctatatcatgtagaagaattcttggataaaagcatccatctaaccaagacggataagaaatatatacttcaattgataagacacggtagatcatag

SEQ ID NO: 142 - protein, 567 aa, vaccinia virus
MDFIRRKYLIYTVENNIDFLKDDTLSKVNNFTLNHVLALKYLVSNFPQHVITKDVLANTNFFVFIHMVRCCKVYEAVLRHAFDAPTLYVKALTKNYLSFSNAIQSYKETVHKLTQDEKFLEVAEYMDELGELIGVNYDLVLNPLFHGGEPIKDMEIIFLKLFKKTDFKVVKKLSVIRLLIWAYLSKKDTGIEFADNDRQDIYTLFQQTGRIVHSNLTETFRDYIFPGDKTSYWVWLNESIANDADIVLNRHAITMYDKILSYIYSEIKQGRVNKNMLKLVYIFEPEKDIRELLLEIIYDIPGDILSIIDAKNDDWKKYFISFYKANFINGNTFISDKTFNEDLFRVVVQINPEYFDNERIMSLFSTSAADIKRFDELDINNSYISNIIYEVNDITLDTMDDMKKCQIFNEDTSYYVKEYNTYLFLHESDPMVIENGILKKLSSIKSKSRRLNLFSKNILKYYLDGQLARLGLVLDDYKGDLLVKMINHLKSVEDVSAFVRFSTDKNPSILPSLIKTILASYNISIIVLFQRFLRDNLYHVEEFLDKSIHLTKTDKKYILQLIRHGRS

SEQ ID NO: 143 - DNA, 501 bp, vaccinia virus
  CDS (1)...(501)
atgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcggagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataa

SEQ ID NO: 144 - protein, 166 aa, vaccinia virus
MGTAATIQTPTKLMNKENAEMILEKIVDHIVMYISDESSDSENNPEYIDFRNRYEDYRSLIIKSDHEFVKLCKNHAEKSSPETQQMIIKHIYEQYLIPVSEVLLKPIMSMGDIITYNGCKDNEWMLEQLSTLNFNNLRTWNSCSIGNVTRLFYTFFSYLMKDKLNI

SEQ ID NO: 145 - DNA, 822 bp, vaccinia virus
  CDS (1)...(822)
atggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacctagatgctagtgactattatcccatttcgttgggattacttaaaaagtttgagtttctcatgtctctatataaaggtcctattcccgtatatgaagaaaaagtaaatactgaattcattgctaatggatctttctccggtagatatgtatcatatcttagaaagttttctgctcttccaacaaacgagtttattagttttttgttactgacttccattccaatctataatatcttgttctggtttaaaaatactcagtttgatattactaaacacacattattcagatacgtctatacagataatgccaaacacctggcgttggctaggtatatgcatcaaacaggagactataagcctttgtttagtcgtctcaaagagaattatatatttaccggtcccgttccaataggtatcaaagatatagatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaa

SEQ ID NO: 146 - protein, 273 aa, vaccinia virus
MAATVPRFDDVYKNAQRRILDQETFFSRGLSRPLMKNTYLFDNYAYGWIPETAIWSSRYANLDASDYYPISLGLLKKFEFLMSLYKGPIPVYEEKVNTEFIANGSFSGRYVSYLRKFSALPTNEFISFLLLTSIPIYNILFWFKNTQFDITKHTLFRYVYTDNAKHLALARYMHQTGDYKPLFSRLKENYIFTGPVPIGIKDIDHPNLSRARSPSDYETLANISTILYFTKYDPVLMFLLFYVPGYSITTKITPAVEYLMDKLNLTKSDVQLL

SEQ ID NO: 147 - DNA, 3018 bp, vaccinia virus
  CDS (1)...(3018)
atggatgttcggtgcattaattggtttgaaagtcacggtgaaaacagatttttatatctgaaatccagatgtcgaaatggtgagaccgtatttatacgatttcctcattacttttattacgtagttacggacgaaatatatcagtcattgtctcctcctccatttaatgcgaggccgttgggaaagatgagaactatagacattgacgagacaataagttataatctagatattaaagatagaaaatgctccgtcgcagatatgtggttgatagaagagccaaagaaacgcagcatacaaaatgccaccatggatgaatttctcaatattagttggttttatatttctaacgggatatctccagacggatgttactcgttggacgagcaatatttgacaaagattaacaatggatgttatcattgtgacgatccacgtaactgtttcgctaaaaaaatacctagattcgatatcccaagatcgtacttatttctagatatagagtgtcacttcgataagaagtttccttctgtatttattaacccaatctcgcatacaagttactgttatatcgatttaagtggtaaacgattattgtttacgctcattaatgaagagatgttaacggaacaggaaatacaagaagccgtcgatagaggatgtttgaggatacagtcactaatggaaatggattacgaacgagaactagttctatgttctgaaatagttttgttacgaatagctaaacaattgttggaactaacgttcgactacgtcgttacctttaacggacataactttgatctgagatatattactaatcgtctagagttattaacaggagagaagattatctttagatctccggacaaaaaggaagctgtacatctctgtatttatgagagaaatcagtctagtcataagggagtaggcggcatggccaatactacgtttcacgttaataacaataatggaactatatttttcgatctatattcattcattcaaaaatctgaaaaattggattcgtacaaattggattctatatccaagaacgcgttcagttgcatgggtaaagtattaaatagaggagttagagaaatgacgttcatcggtgacgatactacagacgcgaaaggcaaagccgctgcatttgcaaaggttttaaccacaggtaattatgtgactgttgatgaggatattatatgtaaagtaattcgtaaagatatttgggaaaatggatttaaagtcgtactattatgtcctactttacctaatgatacatataaattatctttcggaaaggatgacgttgatttagctcagatgtataaggattataatctaaacatagctttagatatggctagatactgtattcatgatgcttgtttgtgtcagtatttgtgggagtattatggagtagaaacaaaaacagacgcgggtgcgtcaacatatgtgcttcctcaatccatggtattcgaatatagagcgagtacagtcatcaagggtccactgttaaagctattgttggaaactaaaactatcttagttagatcagaaacaaaacaaaagtttccttatgaaggcggtaaggtatttgctccaaaacaaaaaatgtttagtaataatgtattaatctttgattataacagtctgtatcctaatgtgtgtatctttggaaatctatctccggaaacattagtcggtgtcgttgttagtaccaatagattggaagaagaaataaataatcagctattgcttcagaaatatccacctcctagatatattacggttcattgtgaacctagactaccgaacctcatctctgaaatagcaattttcgatagatcgatagaaggaaccattcctagactattaagaacatttttggcagagagagccagatataaaaagatgttaaaacaggctaccagttcaactgaaaaggccatctatgattccatgcaatatacgtacaagatagtagccaactcagtatatggtctgatgggatttagaaatagtgctctatactcatacgcttcggctaagagttgcacatccataggacgtagaatgatcttgtatctagaatcggtactaaatggagcagagttatctaacggtatgttacggtttgccaatccattaagtaatccattttatatggacgatagagatattaatccgattgtgaaaacatcgttgcctatagattacagatttcgttttcgtagcgtgtatggagataccgactccgtgtttacagagatagacagtcaagatgtcgataagtctatagaaatagcgaaagagttagaacgactgattaataatagagtattgtttaataattttaaaatagagtttgaggcggtatataagaatctgattatgcaatcgaagaagaaatatacaacgatgaaatactcagcatcgtcgaattcaaaatctgtacctgagagaattaataaaggtactagtgaaactagaagagatgtttccaagtttcataagaatatgattaagatgtacaaaaccagactgtctgagatgttgtctgaaggacggatgaattctaatcaggtatgtatagatattctccgttctttagaaacagatttacgatccgaatttgatagtagatcgtctcctctagaattatttatgttgagtcgaatgcatcactcaaattataaatccgcagataaccctaatatgtatttggttactgaatataataaaaataatccagagactatagaacttggagaacgatattattttgcatatatttgtcctaatggaccatggaccaaaaaacttgtaaatattaaaacatatgaaacaattatcgatagaagttttaaactcggcagtgatcaaagaatattttacgaagtttactttaaacgattgacgtccgaaatagtcaatctattggataataaagttttatgcatctcattctttgaaagaatgtttggttcaaaacctacattttacgaagcataa

SEQ ID NO: 148 - protein, 1005 aa, vaccinia virus
MDVRCINWFESHGENRFLYLKSRCRNGETVFIRFPHYFYYVVTDEIYQSLSPPPFNARPLGKMRTIDIDETISYNLDIKDRKCSVADMWLIEEPKKRSIQNATMDEFLNISWFYISNGISPDGCYSLDEQYLTKINNGCYHCDDPRNCFAKKIPRFDIPRSYLFLDIECHFDKKFPSVFINPISHTSYCYIDLSGKRLLFTLINEEMLTEQEIQEAVDRGCLRIQSLMEMDYERELVLCSEIVLLRIAKQLLELTFDYVVTFNGHNFDLRYITNRLELLTGEKIIFRSPDKKEAVHLCIYERNQSSHKGVGGMANTTFHVNNNNGTIFFDLYSFIQKSEKLDSYKLDSISKNAFSCMGKVLNRGVREMTFIGDDTTDAKGKAAAFAKVLTTGNYVTVDEDIICKVIRKDIWENGFKVVLLCPTLPNDTYKLSFGKDDVDLAQMYKDYNLNIALDMARYCIHDACLCQYLWEYYGVETKTDAGASTYVLPQSMVFEYRASTVIKGPLLKLLLETKTILVRSETKQKFPYEGGKVFAPKQKMFSNNVLIFDYNSLYPNVCIFGNLSPETLVGVVVSTNRLEEEINNQLLLQKYPPPRYITVHCEPRLPNLISEIAIFDRSIEGTIPRLLRTFLAERARYKKMLKQATSSTEKAIYDSMQYTYKIVANSVYGLMGFRNSALYSYASAKSCTSIGRRMILYLESVLNGAELSNGMLRFANPLSNPFYMDDRDINPIVKTSLPIDYRFRFRSVYGDTDSVFTEIDSQDVDKSIEIAKELERLINNRVLFNNFKIEFEAVYKNLIMQSKKKYTTMKYSASSNSKSVPERINKGTSETRRDVSKFHKNMIKMYKTRLSEMLSEGRMNSNQVCIDILRSLETDLRSEFDSRSSPLELFMLSRMHHSNYKSADNPNMYLVTEYNKNNPETIELGERYYFAYICPNGPWTKKLVNIKTYETIIDRSFKLGSDQRIFYEVYFKRLTSEIVNLLDNKVLCISFFERMFGSKPTFYEA

SEQ ID NO: 149 - DNA, 288 bp, vaccinia virus
  CDS (1)...(288)
atgaatcccaaacattggggaagagccgtatggaccattatttttatagtactttcgcaagcgggtttagacggcaacatagaagcgtgtaaacgaaaactatatactatagtcagcactcttccatgtcctgcatgtagacggcacgcgactatcgctatagaggacaataatgtcatgtctagcgatgatctgaattatatttattattttttcatcagattatttaacaatttggcatctgatcccaaatacgcaatcaatgtgtcaaaggttaaccctttataa

SEQ ID NO: 150 - protein, 95 aa, vaccinia virus
MNPKHWGRAVWTIIFIVLSQAGLDGNIEACKRKLYTIVSTLPCPACRRHATIAIEDNNVMSSDDLNYIYYFFIRLFNNLASDPKYAINVSKVNPL

SEQ ID NO: 151 - DNA, 387 bp, vaccinia virus
  CDS (1)...(387)
atggaactcgttaatatttttttagaaacggatgctggaagagtaaagtttgccataaaaaataccgacgatgtatgtgcctcggagttaataaataaatttgtggaactgttaagtgaatacattcacattgaccaatcagaattttatttggtggtaaaggataaggatattttttattttaagtgtgatagggggtctatttcgattgtaaacaatgagttttatgtctttgacgaacccttgctgtttgttaaagatttcactaatgtaacgggggttgaattcatagtcacagaaaccatgccgtgtagaattataccaaaaaataatcacgcggttatttcagttgtgactaatcataagttttataatgggttaagttta

SEQ ID NO: 152 - protein, 129 aa, vaccinia virus
MELVNIFLETDAGRVKFAIKNTDDVCASELINKFVELLSEYIHIDQSEFYLVVKDKDIFYFKCDRGSISIVNNEFYVFDEPLLFVKDFTNVTGVEFIVTETMPCRIIPKNNHAVISVVTNHKFYNGLSL

SEQ ID NO: 153 - DNA, 2001 bp, vaccinia virus
  CDS (1)...(2001)
atgttcatgtatccggaatttgcgaggaaggctttatcaaagcttatttcaaaaaaattaaacattgaaaaggtgtctagcaagcaccagctcgtgttactggattatggattacacggactattgccaaaatcactgtatctggaagctattaattccgatattctcaatgttagattctttcctcctgaaataataaacgtcactgatatcgttaaggctctccaaaattcttgtagagtagatgagtacctaaaagctgtttccttatatcataagaattctttaatggtattgggaccaaatgtagtcaagcttatgatagaatataatcttcttacacacagtgacttggaatggttaattaatgaaaatgtagtcaaggctacataccttttaaaaatcaatgcctatatgattaactttaaaatagatctaacggttgatgaaatcattgacttagttaaagatattcctgtaggagctacgctacatctatataatatattaaacaatatagatttggacattgttcttcgtatatctgatgaatataatataccacctgttcacgatattctgtctaaacttaccgatgaagagatgtgtataaaactagttacaaagtatcctatggacaatgttataaattttattaatcaagatgttagatatagtcccaccttcatcaagacaattaaagattttgtcaacaagcatcttccaaccatgtacgatggattaaatgattatctacattctgttattatcgacgaggacttaatagaggaatataaaattaaatccgttgccatgtttaatttggaatacaaaactgatgtagatactctaacattggacgaacagatatttgtagaggtaaacatctcatattatgattttagatatagacaatttgccgatgaatttagagattacattatgataaaagaaagaagacaaatcaccatgcaatctggtgatagaataagaaggtttagacgtcccatgtcattgagatccactatcatcaaaaaggatactgattctctagaggatattctcgcacatatagataatgccagaaaaaatagcaaggtatccattgaagatgttgagagaatcatttcatctttccgtcttaatccctgtgttgtcagacgcaccatgctgtctgatatagatatcaaaacaaagataatggtgctaaaaattgtcaaagattggaaatcttgtgctctgacactatcagccatcaaaggaattatggtaacagataccatcaataccgtgttatccaaaattctgcatcatcataggaatgtcttcaagtatcttacatctgtagagaataaagaaattgctgtctgtaattgctccagatgtctgtcgctcttctatagagaattaaaaagtgtacgatgtgatctacgcacagatgatggattattggataggctatacgatctgactagatacgccttacacggaaaaatcaatcaaaacttaatcggtcaacgatgttggggtccgttgacagaaatgctgtttaacgaaaataaaaagaaaaaactaaataatttaatggaatacatcaaaatatcagacatgttggtatacggacactctatcgagaagacgcttattccaattactgattctctttcattcaagctatctgttgataccatgtctgtgttaaatgatcaatatgccaaggttgtcatcttcttcaataccatcatagaatatattatagctactatctattatagattgacagtcttggacaattatactaatgtcaaacattttgtatccaaagtgttacacactgtcatggaagcatgtggcgtactgttttcatacattaaagttaatgacaaaatagagcatgaattggaggagatggtggacaaaggtaccgtaccttcttatttgtatcatctgtccatcaacgtcatttcaataatattggatgatataaatggaactcgttaa

SEQ ID NO: 154 - protein, 666 aa, vaccinia virus
MFMYPEFARKALSKLISKKLNIEKVSSKHQLVLLDYGLHGLLPKSLYLEAINSDILNVRFFPPEIINVTDIVKALQNSCRVDEYLKAVSLYHKNSLMVLGPNVVKLMIEYNLLTHSDLEWLINENVVKATYLLKINAYMINFKIDLTVDEIIDLVKDIPVGATLHLYNILNNIDLDIVLRISDEYNIPPVHDILSKLTDEEMCIKLVTKYPMDNVINFINQDVRYSPTFIKTIKDFVNKHLPTMYDGLNDYLHSVIIDEDLIEEYKIKSVAMFNLEYKTDVDTLTLDEQIFVEVNISYYDFRYRQFADEFRDYIMIKERRQITMQSGDRIRRFRRPMSLRSTIIKKDTDSLEDILAHIDNARKNSKVSIEDVERIISSFRLNPCVVRRTMLSDIDIKTKIMVLKIVKDWKSCALTLSAIKGIMVTDTINTVLSKILHHHRNVFKYLTSVENKEIAVCNCSRCLSLFYRELKSVRCDLRTDDGLLDRLYDLTRYALHGKINQNLIGQRCWGPLTEMLFNENKKKKLNNLMEYIKISDMLVYGHSIEKTLIPITDSLSFKLSVDTMSVLNDQYAKVVIFFNTIIEYIIATIYYRLTVLDNYTNVKHFVSKVLHTVMEACGVLFSYIKVNDKIEHELEEMVDKGTVPSYLYHLSINVISIILDDINGTR

SEQ ID NO: 155 - DNA, 324 bp, vaccinia virus
  CDS (1)...(324)
atggccgaggaatttgtacaacaaaggttggccaataacaaagtgacaatttttgtcaagtatacatgtcctttttgtagaaatgcactggatattctaaataagtttagtttcaaaagaggagcgtatgaaattgtcgatattaaagaatttaaacccgaaaatgaattgcgggattattttgaacaaattactggtggtagaactgttcctagaatcttttttgggaaaacttctattggtggatatagcgacctgttggaaatagacaacatggacgcattgggtgatattctatcatctattggggtattgagaacttgt

SEQ ID NO: 156 - protein, 108 aa, vaccinia virus
MAEEFVQQRLANNKVTIFVKYTCPFCRNALDILNKFSFKRGAYEIVDIKEFKPENELRDYFEQITGGRTVPRIFFGKTSIGGYSDLLEIDNMDALGDILSSIGVLRTC

SEQ ID NO: 157 - DNA, 936 bp, vaccinia virus
  CDS (1)...(936)
atggcggaatttgaagatcaactcgttttcaatagtatcagtgcccgtgcattgaaagcttatttcactgctaaaatcaatgaaatggtagatgagttggtcacaagaaaatgtccacaaaagaaaaaatcacaagctaagaaacctgaagtacgcattcctgtagatcttgtaaagtctagttttgtgaaaaagtttggattgtgcaattatggaggaatccttatcagtcttattaatagtctagtagaaaataatttctttacaaaggatggaaaactggatgatacaggcaaaaaggaattggttttgacagatgtcgaaaaacgaattcttaatgccatcgataaatcatctcctttgtatatcgatattagtgatgttaaagtattggctgctagactaaaaagaagcgctacacaatttaactttaatggacatacatatcatctggaaaatgataaaatagaagatctcattaatcagttggttaaggacgaatccattcaactggatgaaaagagttctattaaagatagtatgtatgtcattcccgatgaacttatcgatgttctcaaaactagattgtttagatctcctcaagtcaaggataatattatttcgcgtactagattgtatgattattttactagagttactaagagagacgaatcgtcaatctatgtgattctaaaggatcctaggatcgctagcattttgtcactagaaactgttaaaatgggcgcctttatgtatacaaaacatagtatgttgacgaacgctatttcatctagagtcgatagatattctaaaaagtttcaagaatctttttacgaagatattgcagaatttgttaaagaaaatgagagagttaatgtatcgagagtggttgaatgtttgactgtgcctaatattactatatcaagtaatgctgaa

SEQ ID NO: 158 - protein, 312 aa, vaccinia virus
MAEFEDQLVFNSISARALKAYFTAKINEMVDELVTRKCPQKKKSQAKKPEVRIPVDLVKSSFVKKFGLCNYGGILISLINSLVENNFFTKDGKLDDTGKKELVLTDVEKRILNAIDKSSPLYIDISDVKVLAARLKRSATQFNFNGHTYHLENDKIEDLINQLVKDESIQLDEKSSIKDSMYVIPDELIDVLKTRLFRSPQVKDNIISRTRLYDYFTRVTKRDESSIYVILKDPRIASILSLETVKMGAFMYTKHSMLTNAISSRVDRYSKKFQESFYEDIAEFVKENERVNVSRVVECLTVPNITISSNAE

SEQ ID NO: 159 - DNA, 219 bp, vaccinia virus
  CDS (1)...(219)
atggataagttgtacgccgctatatttggtgtatatatgggttctccgaaagatgatttgacagactttatagaaattgttaaatctgttctaagtgatgagaaaactaccacatcaactaataataccggttgttggggttggtattggttaattattattttttttatagttcttattctactactattgatatatttgtatttaaaagttgtttgg

SEQ ID NO: 160 - protein, 73 aa, vaccinia virus
MDKLYAAIFGVYMGSPKDDLTDFIEIVKSVLSDEKTTTSTNNTGCWGWYWLIIIFFIVLILLLLIYLYLKVVW

SEQ ID NO: 161 - DNA, 810 bp, vaccinia virus
  CDS (1)...(810)
atgagtaaggtaatcaagaagagagttgaaacttcaccaagacctactgcatctagcgattctctacagacttgtgcgggtgttatagagtatgcaaaatcgattagtaaatctaatgcaaaatgtatcgaatacgttacactaaatgcttctcaatacgctaattgttcgtctatctctataaaacttactgatagtttatctagtcaaatgacttccacttttattatgttggaaggagagactaaactttataaaaataaatctaaacaagatagaagcgatggatactttctaaaaataaaagttaccgcggctagtcctatgttgtatcaacttctagaagccgtctatggaaacattaagcacaaggaacgcattccaaattctttgcatagtctttcggtggaaactattacagagaaaacatttaaggatgaatccatcttcatcaacaaattaaacggatccatggtagaatatgtttcgactggagaatcatccattctcagatctatagaaggtgaactagaatcactcagtaaaagagaaagacaattggccaaggcaattatcacacctgtagttttctatagatccggaacggaaacaaaaattacattcgcactcaagaaactaatcattgatagagaagtggtggctaacgttatcggactctctggagatagtgaacgtgtatcaatgactgaaaatgtagaagaagatctggctcgtaatctgggacttgttgatattgatgatgaatatgatgaagatagcgataaagaaaagccaatattcaatgtataa

SEQ ID NO: 162 - protein, 269 aa, vaccinia virus
MSKVIKKRVETSPRPTASSDSLQTCAGVIEYAKSISKSNAKCIEYVTLNASQYANCSSISIKLTDSLSSQMTSTFIMLEGETKLYKNKSKQDRSDGYFLKIKVTAASPMLYQLLEAVYGNIKHKERIPNSLHSLSVETITEKTFKDESIFINKLNGSMVEYVSTGESSILRSIEGELESLSKRERQLAKAIITPVVFYRSGTETKITFALKKLIIDREVVANVIGLSGDSERVSMTENVEEDLARNLGLVDIDDEYDEDSDKEKPIFNV

SEQ ID NO: 163 - DNA, 2313 bp, vaccinia virus
  CDS (1)...(2313)
atgtttgtcattaaacgaaatggatacaaggaaaatgtcatgtttgataaaatcacgtctcgtattagaaaattatgttatggcttaaacacggatcatatagatcctattaaaatagctatgaaggttattcaaggaatatataatggagtaacaacggtagaattggacactctggcagccgaaatagcagccacttgtactacacaacatccggattatgccattctagccgccagaatagccgtatcaaatctacacaaggaaacaaaaaaactatttagtgaagtgatggaggatttattcaactatgttaatcctaaaaatgggaaacattctccgattatttcaagtatcaccatggatatagttaacaaatataaggataaactcaactcggttattatttacgaacgagacttttcatacaactattttggttttaaaactttggaaaaatcctacttgttgaaaataaacaacaagatcgttgaaagacctcagcacatgttaatgcgtgtcgcagtaggaattcatcaatgggatatagactcagctattgagacgtacaatctactttctgaaaaatggtttacgcacgcttctcctaccttatttaatgcgggaactagtcgtcaccaaatgtctagctgttttctacttaacatgatcgatgatagcatagagggtatctatgacacgttaaaacgatgcgcattaatctctaaaatggcagggggaataggtctatcaattagtaatattcgtgccagtggaagctatatctccggtaccaatggtatatcaaacggtattattccaatgttgagagtttataataacaccgctagatacatagatcagggaggaaacaaacggcctggagttatggccatatacttggaaccgtggcattctgatattatggcgttcctcgatcttaaaaagaatacaggaaacgaggaacatagaaccagagatctatttatagctctttggattcctgatctctttatgaaacgagtgaaggatgacggagagtggtcgttgatgtgtccggatgaatgtcctggattggacaatgtttggggagacgagttcgaacgattgtatacactatacgaaagagaaaggagatacaaatctataataaaggctcgagtcgtctggaaagcgattatagaatctcagattgaaactggtactccattcattctttataaggatgcgtgtaacaaaaagagtaatcaacaaaatttaggaactatcaagtgtagtaatctttgcactgagataatacaatatgcggatgctaatgaggtagccgtttgtaatctggcatctgttgccttgaacatgtttgtaatagatgggcgatttgattttctcaaactgaaggatgtggtcaaagtaattgtcagaaatctcaataaaattatagatattaattattatcctattccagaagctgaaatctctaataagagacatagacctatcggtattggtgttcaaggattagcggacgcgtttattctcttaaattatccatttgatagcctggaagcacaagatctaaataagaagatcttcgaaaccatttattacggtgcattagaggcgagttgtgaactagctgagaaggaaggaccatacgatacatatgtaggatcgtacgccagtaacggtattctacaatatgatctttggaatgttgtaccgtcggatctttggaattgggaacctctaaaagataaaatcagaacatacggtcttagaaatagtttattggtggcacctatgccgactgcatcaactgctcaaattttgggaaataatgagtcggtggaaccgtataccagtaatatttacactcggagagtattgtctggagaatttcaagtagttaatccgcatctccttagagttttaaccgagagaaaattatggaatgatgagatcaagaataggattatggcagatggtggatccattcagaatacaaaccttccagaagatattaagcgagtttataaaactatttgggaaattccacaaaagacgatcataaaaatggctgcagacaggggagccttcatcgatcaaagtcaatctatgaatatccatatagcagatccgagttattccaaactaacgagtatgcatttttacggatggagtctcggtctaaaaacgggaatgtactatctacgtacgaaacccgcatccgctcccattcaattcacattggacaaggataaaataaaaccactggtggtttgcgattccgaaatctgtacatcatgcagtggt

SEQ ID NO: 164 - protein, 771 aa, vaccinia virus
MFVIKRNGYKENVMFDKITSRIRKLCYGLNTDHIDPIKIAMKVIQGIYNGVTTVELDTLAAEIAATCTTQHPDYAILAARIAVSNLHKETKKLFSEVMEDLFNYVNPKNGKHSPIISSITMDIVNKYKDKLNSVIIYERDFSYNYFGFKTLEKSYLLKINNKIVERPQHMLMRVAVGIHQWDIDSAIETYNLLSEKWFTHASPTLFNAGTSRHQMSSCFLLNMIDDSIEGIYDTLKRCALISKMAGGIGLSISNIRASGSYISGTNGISNGIIPMLRVYNNTARYIDQGGNKRPGVMAIYLEPWHSDIMAFLDLKKNTGNEEHRTRDLFIALWIPDLFMKRVKDDGEWSLMCPDECPGLDNVWGDEFERLYTLYERERRYKSIIKARVVWKAIIESQIETGTPFILYKDACNKKSNQQNLGTIKCSNLCTEIIQYADANEVAVCNLASVALNMFVIDGRFDFLKLKDVVKVIVRNLNKIIDINYYPIPEAEISNKRHRPIGIGVQGLADAFILLNYPFDSLEAQDLNKKIFETIYYGALEASCELAEKEGPYDTYVGSYASNGILQYDLWNVVPSDLWNWEPLKDKIRTYGLRNSLLVAPMPTASTAQILGNNESVEPYTSNIYTRRVLSGEFQVVNPHLLRVLTERKLWNDEIKNRIMADGGSIQNTNLPEDIKRVYKTIWEIPQKTIIKMAADRGAFIDQSQSMNIHIADPSYSKLTSMHFYGWSLGLKTGMYYLRTKPASAPIQFTLDKDKIKPLVVCDSEICTSCSG

SEQ ID NO: 165 - DNA, 237 bp, vaccinia virus
  CDS (1)...(237)
atggtggatgctataaccgttctaactgcgatcggcataactgtattaatgcttttgatggtaatttctggcgccgccatgatagtcaaggagttaaatcctaatgatatattcactatgcaatcattaaagtttaatcgagccgtaacgattttcaaatatataggactctttatctatataccaggaacgataattttgtacgctacatacgtcaaatccctattaatgaaaagt

SEQ ID NO: 166 - protein, 79 aa, vaccinia virus
MVDAITVLTAIGITVLMLLMVISGAAMIVKELNPNDIFTMQSLKFNRAVTIFKYIGLFIYIPGTIILYATYVKSLLMKS

SEQ ID NO: 167 - DNA, 1146 bp, vaccinia virus
  CDS (1)...(1146)
atgaataactttgttaaacaagtagcttcaaagtctctaaaacctaccaaaaaattgtctccgtcagatgaggtgatatctttaaacgaatgcataatatcctttaacttggataacttttattattgcaacgatgtactgtttactaagcccattaatactccggaggatgttctcaaatcactcttgatcatggaatcattcgcgtacgagaagatgataatcaaaggattaataaaaatactaatatttagagcatatattaatgatatttattttactccattcggttggttgacgggcgtcgacgatgatcctgaaacacacgtggtgataaaaataattttcaattcatcactaatatctatcaagtctcaagttatagaatatttaaaaccatacaatgtcaataacctatcggtacttaccacagaaaaagaattaagtattaatacgttcaatgttccggattctatacctatgtcgataatttcgtttttcccattcgatacagattttatactagttattttgttttttggagtatataatgactcgtattgtggaataagctatataagtccgaaagagagactaccgtatatcatcgaaatattaaaaccgttggtgtcggaaattaacatgttatcggatgaaataggtagaacatcatccattagaatcttcaattccactagcgtcaaaaaatttcctactaatacattaacatccatttgtgaaattgtttattcgtttgacgaatcatcctttccgacgcccaagacgttcactcctctaaacgcgagtccatacattcctaaaaagatagtttcactattggatttaccatctaatgtggaaataaaagcgatatctagaggcggtgtggatttcatcactcatattaataataagcgtctaaacacaatcttggtaatagcaaaagataactttttaaaaaattctacattttctggaacttttatcaaagagaatattatttggaagggtatctatacttatagaataatcaagtctagttttccagttcctactattaagtcggttactaataagaaaaaaatatgtaagaaacattgtttcgtcaattctcagtatacaactaggactttgtcacatattctt

SEQ ID NO: 168 - protein, 382 aa, vaccinia virus
MNNFVKQVASKSLKPTKKLSPSDEVISLNECIISFNLDNFYYCNDVLFTKPINTPEDVLKSLLIMESFAYEKMIIKGLIKILIFRAYINDIYFTPFGWLTGVDDDPETHVVIKIIFNSSLISIKSQVIEYLKPYNVNNLSVLTTEKELSINTFNVPDSIPMSIISFFPFDTDFILVILFFGVYNDSYCGISYISPKERLPYIIEILKPLVSEINMLSDEIGRTSSIRIFNSTSVKKFPTNTLTSICEIVYSFDESSFPTPKTFTPLNASPYIPKKIVSLLDLPSNVEIKAISRGGVDFITHINNKRLNTILVIAKDNFLKNSTFSGTFIKENIIWKGIYTYRIIKSSFPVPTIKSVTNKKKICKKHCFVNSQYTTRTLSHIL

SEQ ID NO: 169 - DNA, 1269 bp, vaccinia virus
  CDS (1)...(1269)
atggaaagatatacagatttagtaattagtaaaataccagaactaggatttaccaatttattatgtcatatatattcactagctggattatgtagcaatatagatgtatctaaatttttaacaaattgtaacggatatgtagtggaaaaatatgataaatctacaaccgccggcaaagtgtcttgtattcctatcggtatgatgttggaactagtagagtcggggcacctgagcagacccaatagtagcgacgaactcgatcaaaagaaagagttaaccgacgagttaaagacgcgttaccattctatatatgatgtctttgagttacctactagtataccgttagcgtatttctttaaacctcgactacgggaaaaagtatctaaggcgatagacttctcacaaatggatttgaaaatcgatgatttatcacgtaaaggaatacatactggtgaaaatccaaaggtcgtcaagatgaaaatagagcctgagagaggagcctggatgagcaatcgaagtattaagaacttagtctctcagtttgcttatggatccgaagtggattatataggacaatttgacatgagattcttaaactccttagcgattcatgaaaaatttgacgcgtttatgaataaacatatcttatcgtatatacttaaagacaaaattaaaagttctacctctagatttgtaatgtttggattttgttatttgtctcattggaaatgtgtaatttatgataaaaaacaatgtttagtatccttttatgactccggaggcaatattccaactgaattccaccactataataatttttatttctattccttctccgatggttttaacacgaatcacagacattctgtattggataatacaaattgtgacatcgatgttttattcagatttttcgaatgtacatttggagcgaaaataggctgtattaatgtagaagttaatcagctgttggaatctgaatgtggaatgtttattagtttgtttatgatattgtgtactaggacaccacctaagagtttcaaatctctgaaaaaggtttatacattctttaaatttttagcggataagaaaatgacattatttaagagcattctatttaacctgcacgatctatcactggatataacggaaacggataacgcaggattaaaagaatataaacgtatggaaaagtggaccaaaaagtcaattaatgtgatatgtgataaattaactacaaaattaaatagaatagtaaacgacgatgaa

SEQ ID NO: 170 - protein, 423 aa, vaccinia virus
MERYTDLVISKIPELGFTNLLCHIYSLAGLCSNIDVSKFLTNCNGYVVEKYDKSTTAGKVSCIPIGMMLELVESGHLSRPNSSDELDQKKELTDELKTRYHSIYDVFELPTSIPLAYFFKPRLREKVSKAIDFSQMDLKIDDLSRKGIHTGENPKVVKMKIEPERGAWMSNRSIKNLVSQFAYGSEVDYIGQFDMRFLNSLAIHEKFDAFMNKHILSYILKDKIKSSTSRFVMFGFCYLSHWKCVIYDKKQCLVSFYDSGGNIPTEFHHYNNFYFYSFSDGFNTNHRHSVLDNTNCDIDVLFRFFECTFGAKIGCINVEVNQLLESECGMFISLFMILCTRTPPKSFKSLKKVYTFFKFLADKKMTLFKSILFNLHDLSLDITETDNAGLKEYKRMEKWTKKSINVICDKLTTKLNRIVNDDE

SEQ ID NO: 171 - DNA, 2031 bp, vaccinia virus
  CDS (1)...(2031)
atggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccacgaaacaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatatttttagcgtggatttctcatagacctgtagttttaactggaggaactggagtgggtaagacgtcacaggtacccaagttattgctttggtttaattatttatttggtggattctctactctagataaaatcactgactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgacagggaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggttttagatatagacgaaatattagaaaaagtgtattcatcacctaatgtatcgataattatttctactccttatttggaatccagcgttactatacacaatgttacacacatttatgatatgggtagagtttttgtccccgctccttttggaggatcgcaacaatttatttctaaatctatgagagatcaacgaaaaggaagagtaggaagagttaatcctggtacatacgtctatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataattttgagaggacgggagaattaactagtattgtacaagaagccattttatctctaaatttacgaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaa

SEQ ID NO: 172 - protein, 676 aa, vaccinia virus
MEKNLPDIFFFPNCVNVFSYKYSQDEFSNMSKTERDSFSLAVFPVIKHRWHNAHVVKHKGIYKVSTEARGKKVSPPSLGKPAHINLTTKQYIYSEHTISFECYSFLKCITNTEINSFDEYILRGLLEAGNSLQIFSNSVGKRTDTIGVLGNKYPFSKIPLASLTPKAQREIFLAWISHRPVVLTGGTGVGKTSQVPKLLLWFNYLFGGFSTLDKITDFHERPVILSLPRIALVRLHSNTILKSLGFKVLDGSPISLRYGSIPEELINKQPKKYGIVFSTHKLSLTKLFSYGTLIIDEVHEHDQIGDIIIAVARKHHTKIDSMFLMTATLEDDRERLKVFLPNPAFIHIPGDTLFKISEVFIHNKINPSSRMAYIEEEKRNLVTAIQMYTPPDGSSGIVFVASVAQCHEYKSYLEKRLPYDMYIIHGKVLDIDEILEKVYSSPNVSIIISTPYLESSVTIHNVTHIYDMGRVFVPAPFGGSQQFISKSMRDQRKGRVGRVNPGTYVYFYDLSYMKSIQRIDSEFLHNYILYANKFNLTLPEDLFIIPTNLDILWRTKEYIDSFDISTETWNKLLSNYYMKMIEYAKLYVLSPILAEELDNFERTGELTSIVQEAILSLNLRIKILNFKHKDDDTYIHFCKILFGVYNGTNATIYYHRPLTGYMNMISDTIFVPVDNN

SEQ ID NO: 173 - DNA, 1773 bp, vaccinia virus
  CDS (1)...(1773)
atgattgtcttaccgaataaagttcgtattttcatcaacgatcggatgaaaaaggatatctacttgggaatttctaatttcggattcgagaatgatatagatgaaatcttgggaattgctcacttgttggaacatctacttatatcctttgattctactaattttttagcgaatgcttctacatctagaagttatatgagtttttggtgtaaatccattaattcagcaacggaatcggacgcaatcagaacattagtttcgtggttcttttctaacggaaaactcaaagataatttttccctttctagtatacgatttcacattaaagaattagaaaacgaatactattttagaaatgaagtattccattgtatggatatactaacgtttcttagcggaggcgatttatataacggtgggagaatagacatgatagataatcttaatatagttcgtgatatgctggtaaatagaatgcaaaggatatcgggatcgaatatcgtaatttttgttaagagattaggacctggaacattggatttcttcaaacagacatttgggtctttaccagcatgtccggagattattccttcatctattccagtaagtacaaacggtaaaatagttatgactccgtctccattttatacagttatggtaaagattaatccaacattagataatattttagggattctgtatttgtacgaaacttaccacttaatagactatgagactatcggcaaccagttatatttaacggtatcctttatcgatgaaactgaatacgagagctttcttcgtggcgaggctatattacaaattagtcaatgtcaacgtattaatatgaattatagcgacgattatatgatgaacatctatttaaattttccttggctatcgcatgatttatatgattacattacacgtattaatgacgatagcaagtcgatactaatatccttgacaaatgaaatatatgcatctataattaatagagatatcatagttatttacccaaactttagtaaggccatgtgtaacactagagatacccaacaacatccgatagtagttcttgacgcaaccaatgatggactgattaagaaaccttatagaagtatacccctaatgaagcgtctaacatctaatgaaatatttatacgatacggagacgcgtctctcatggacatgataactttatcattgtctaaacaagatatatcattaaaaagaaatgccgaaggaatacgtgtaaaacatagtttttcagctgatgatatacaggcaattatggaatctgattcgtttttaaagtatagtagatcaaaaccagctgcgatgtatcaatatatatttctatcattttttgctagtggtaattccatagatgacatattggcaaatagagattctaccttagaattttctaaaagaactaaaagtaaaattttgtttggtaggaataccaggtacgacgtcactgcaaaatctagttttgtatgtggtatagtacgaggtaaatcattggataaaacgtctctggttgaaatgatgtgggatctcaagaagaaaggattaatatattctatggaatttaccaatctattgagcaagaataccttttatctgttcacatttactatctacactgatgaagtatacgattatctaaacactaataaacttttttctgcaaaatgtttagtcgtgtctacaaaaggagatgtggaaaatttttcatctctaaaaaaagatgtggtcattagagtt

SEQ ID NO: 174 - protein, 591 aa, vaccinia virus
MIVLPNKVRIFINDRMKKDIYLGISNFGFENDIDEILGIAHLLEHLLISFDSTNFLANASTSRSYMSFWCKSINSATESDAIRTLVSWFFSNGKLKDNFSLSSIRFHIKELENEYYFRNEVFHCMDILTFLSGGDLYNGGRIDMIDNLNIVRDMLVNRMQRISGSNIVIFVKRLGPGTLDFFKQTFGSLPACPEIIPSSIPVSTNGKIVMTPSPFYTVMVKINPTLDNILGILYLYETYHLIDYETIGNQLYLTVSFIDETEYESFLRGEAILQISQCQRINMNYSDDYMMNIYLNFPWLSHDLYDYITRINDDSKSILISLTNEIYASIINRDIIVIYPNFSKAMCNTRDTQQHPIVVLDATNDGLIKKPYRSIPLMKRLTSNEIFIRYGDASLMDMITLSLSKQDISLKRNAEGIRVKHSFSADDIQAIMESDSFLKYSRSKPAAMYQYIFLSFFASGNSIDDILANRDSTLEFSKRTKSKILFGRNTRYDVTAKSSFVCGIVRGKSLDKTSLVEMMWDLKKKGLIYSMEFTNLLSKNTFYLFTFTIYTDEVYDYLNTNKLFSAKCLVVSTKGDVENFSSLKKDVVIRV

SEQ ID NO: 175 - DNA, 336 bp, vaccinia virus
  CDS (1)...(336)
atggcatctttattatatcttattttatttttgttattcgtatgtatttcttattattttacatattatccgaccaataaacttcaggcagctgtaatggaaacagatagagaaaacgctattattagacagcgaaatgatgaaataccgactagaacattagatacagctatatttaccgatgcatcaaccgtcgcgagtgcgcaaatacacctatattataattccaatattggtaaaattataatgtcacttaatggtaaaaaacacacctttaatttatacgatgataacgacatacgaacattacttcctattttactccttagtaaatga

SEQ ID NO: 176 - protein, 111 aa, vaccinia virus
MASLLYLILFLLFVCISYYFTYYPTNKLQAAVMETDRENAIIRQRNDEIPTRTLDTAIFTDASTVASAQIHLYYNSNIGKIIMSLNGKKHTFNLYDDNDIRTLLPILLLSK

SEQ ID NO: 177 - DNA, 663 bp, vaccinia virus
  CDS (1)...(663)
atgccatttagagatctaattttgttcaacttgtccaaattcctacttacagaagatgaggaatcgttggagatagtgtcttccttatgtagaggatttgaaatatcttatgatgacttgataacttactttccagataggaaataccataaatatatttataaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagggaagcaaatgatgacttgatagaatatctcctcaaggaatacactcctcagatttatacatattctaatgagcgagttcccatagctggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaacaggtggccaaactccatag

SEQ ID NO: 178 - protein, 220 aa, vaccinia virus
MPFRDLILFNLSKFLLTEDEESLEIVSSLCRGFEISYDDLITYFPDRKYHKYIYKVFEHVDLSEELSMEFHDTTLRDLVYLRLYKYSKCIRPCYKLGDNLKGIVVIKDRNIYIREANDDLIEYLLKEYTPQIYTYSNERVPIAGSKLILCGFSQVTFMAYTTSHITTNKKVDVLVSKKCIDELVDPINYQILQNLFDKGSGTINKILRKIFYSVTGGQTP

SEQ ID NO: 179 - DNA, 372 bp, vaccinia virus
  CDS (1)...(372)
atgaagaacgtattgattattttcggtaaaccgtattgtagtatttgtgaaaatgtcagtgagtcagtagaagaattaaaatccgagtatgatatactccatgttgatatcttatcattttttttaaaggatggtgattcaagtatgctgggtgacgtaaagcgcggaaccctaataggaaactttgcagcgcatctatctaactacatcgtttccattttcaaatacaatccacagacaaaacaaatggcatttgtggacattaataaatccttggatttcaccaaaaccgataaatcgctggtgaatttggaaattctaaaatccgaaatagaaaaagctacctatggagtttggccacctgttaccgaa

SEQ ID NO: 180 - protein, 124 aa, vaccinia virus
MKNVLIIFGKPYCSICENVSESVEELKSEYDILHVDILSFFLKDGDSSMLGDVKRGTLIGNFAAHLSNYIVSIFKYNPQTKQMAFVDINKSLDFTKTDKSLVNLEILKSEIEKATYGVWPPVTE

SEQ ID NO: 181 - DNA, 1305 bp, vaccinia virus
  CDS (1)...(1305)
atgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgttagaattagaaaagtgtacatccgaaatacaaaatgttaccggatttatggaagaagaaataaaggcaaaaatgcaattaaaaatcgataaacttacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctgctgataatcatcctaagatgataaaaaacttaactcaactgtttaaatatgttccatctgcagaggataactatttagcaaaattaacggcgttagtgaatggatgtgatttctttcctggactctatggggcatctataacacccaacaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatgttcctccttgtcaatgcactgttcaagaatttatattttccgcattagatgaaaaatggaacaattttaaatcatcttatttagagaccgttccgttaccctgtcaattaatgtacgcgttagaaccacgtaaggagattgatgtttcagaagttaaaactttatcatcttatatagatttcgaaaatactaaatcagatatcgatgttataaaatctatatcctcgatttttggatattctaacgaaaactgtaacactatagtgttcggcatctataaggataatttactactgagtataaatagttcattttactttaacgatagtctgttaataaccaatactaaaagtgataatataataaatataggttactag

SEQ ID NO: 182 - protein, 434 aa, vaccinia virus
MGIKNLKSLLLENKSLTILDDNLYKVYNGIFVDTMSIYIAVANCVRNLEELTTVFIKYVNGWVKKGGHVTLFIDRGSIKIKQDVRDKRRKYSKLTKDRKMLELEKCTSEIQNVTGFMEEEIKAKMQLKIDKLTFQIYLSDSDNIKISLNEILTHFNNNENVTLFYCDERDAEFVMCLEAKTHFSTTGEWPLIISTDQDTMLFASADNHPKMIKNLTQLFKYVPSAEDNYLAKLTALVNGCDFFPGLYGASITPNNLNKIQLFSDFTIDNIVTSLAIKNYYRKTNSTVDVRNIVTFINDYANLDDVYSYVPPCQCTVQEFIFSALDEKWNNFKSSYLETVPLPCQLMYALEPRKEIDVSEVKTLSSYIDFENTKSDIDVIKSISSIFGYSNENCNTIVFGIYKDNLLLSINSSFYFNDSLLITNTKSDNIINIGY

SEQ ID NO: 183 - DNA, 192 bp, vaccinia virus
  CDS (1)...(192)
atggtgttccaactcgtgtgctctacatgcggtaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaa

SEQ ID NO: 184 - protein, 63 aa, vaccinia virus
MVFQLVCSTCGKDISHERYKLIIRKKSLKDVLVSVKNECCRLKLSTQIEPQRNLTVQPLLDIN

SEQ ID NO: 185 - DNA, 498 bp, vaccinia virus
  CDS (1)...(498)
atggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctaatacgtcattaactttattgggtattccgtatggatttggtcataatagaatgtattgttttaaattggtagctgaatgttataaaaatgccggtattgatacatcgtctaaacgaatattgggcaaagatatttttctgagccaaaacttcacagacgataatagatggataaagatatatgattctaataatttaacattttggcaaattgattaccttaaagggtga

SEQ ID NO: 186 - protein, 165 aa, vaccinia virus
MDPVNFIKTYAPRGSIIFINYTMSLTSHLNPSIEKHVGIYYGTLLSEHLVVESTYRKGVRIVPLDSFFEGYLSAKVYMLENIQVMKIAANTSLTLLGIPYGFGHNRMYCFKLVAECYKNAGIDTSSKRILGKDIFLSQNFTDDNRWIKIYDSNNLTFWQIDYLKG

SEQ ID NO: 187 - DNA, 1113 bp, vaccinia virus
  CDS (1)...(1113)
atggctgcagaacagcgtcgttctacaatttttgacatagtttcaaaatgtatagtgcaatctgtattaagagatatatctattaattctgaatacatagagtccaaagctaaacaattgtgctattgtccggcatcgaaaaaggaatcagtgattaatggtatttacaattgttgcgagtcaaatatagaaataatggacaaagagcagctattaaaaatattggacaatcttcgatgtcattcggctcatgtatgtaacgccacagatttctggagactatataattcgttaaaacggtttactcatactaccgcattctttaatacatgcaagcccactattctagccacgctaaacactttgataaccctgattttatctaacaagttattgtatgcggcagaaatggtagagtatctagagaaccaactagattcatcaaataaatcaatgtctcaagaactagcagaattattggaaatgaaatatgctctcattaatctggtacaatataggattttgccaatgatcatcggtgagcctattatagtagctggattttctggtaaagaaccaatttctgattattctgcagaagtggaaaggctaatggaactaccagttaaaactgatatagtgaataccacatatgacttcttagcaagaaaaggtattgatactagcaacaatatagcagaatatatagccggcttgaaaatagaagagattgaaaaggtagaaaaatatttaccagaagttatatctacaattgccaatagtaatataataaaaaataaaaaatctatctttccggccaatatcaacgataaacagatcatggaatgctctagaatgttagacacgagtgagaaatactctaaaggatataaaactgatggagctgtgactagtccattgacgggaaataatacaattacaacatttataccaatttctgcgtccgatatgcaaaagtttaccattttagaatatctttacattatgagagtgatggcaaacaacgttaagaaaaagaacgagggaaaaaacaacggaggagtagttatgcatattaactcaccctttaaggtaatcaatttgccaaaatgt

SEQ ID NO: 188 - protein, 371 aa, vaccinia virus
MAAEQRRSTIFDIVSKCIVQSVLRDISINSEYIESKAKQLCYCPASKKESVINGIYNCCESNIEIMDKEQLLKILDNLRCHSAHVCNATDFWRLYNSLKRFTHTTAFFNTCKPTILATLNTLITLILSNKLLYAAEMVEYLENQLDSSNKSMSQELAELLEMKYALINLVQYRILPMIIGEPIIVAGFSGKEPISDYSAEVERLMELPVKTDIVNTTYDFLARKGIDTSNNIAEYIAGLKIEEIEKVEKYLPEVISTIANSNIIKNKKSIFPANINDKQIMECSRMLDTSEKYSKGYKTDGAVTSPLTGNNTITTFIPISASDMQKFTILEYLYIMRVMANNVKKKNEGKNNGGVVMHINSPFKVINLPKC

SEQ ID NO: 189 - DNA, 783 bp, vaccinia virus
  CDS (1)...(783)
atgagcatccgtataaaaatcgataaactgcgccaaattgtggcatatttttcagagttcagtgaagaagtgtctataaatgtagactcgacggatgagttaatgtatatttttgccgccttgggcggatctgtaaacatttgggccattatacctctcagtgcatcagtgttctaccgcggagccgaaaatattgtgtttaatcttccggtgtccaaggtaaaatcgtgtttgtgtagttttcacaatgatgccatcatagatatagaacctgatctgaaaaataatctagtaaaactttctagttatcatgtagtaagtgtcgattgtaacaaggaactgatgcctattaggacagatactactatttgtctaagtatagatcaaaagaaatcttatgtgtttaattttcacaagtatgaagaaaaatgttgtggtagaaccgtcattcatctagaatggttgttgggctttatcaagtgtattagtcagcatcagcatctggctattatgtttaaagatgacaatattattatgaagactcctggtaatactgatgcattttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattttaggaatgttgttttcggatagagttcaatcctttaagatcaacatctttatggcgtttttagattaa

SEQ ID NO: 190 - protein, 260 aa, vaccinia virus
MSIRIKIDKLRQIVAYFSEFSEEVSINVDSTDELMYIFAALGGSVNIWAIIPLSASVFYRGAENIVFNLPVSKVKSCLCSFHNDAIIDIEPDLKNNLVKLSSYHVVSVDCNKELMPIRTDTTICLSIDQKKSYVFNFHKYEEKCCGRTVIHLEWLLGFIKCISQHQHLAIMFKDDNIIMKTPGNTDAFSREYSMTECSQELQKFSFKIAISSLNKLRGFKKRVNVFETRIVMDNDDNILGMLFSDRVQSFKINIFMAFLD

SEQ ID NO: 191 - DNA, 1023 bp, vaccinia virus
  CDS (1)...(1023)
atgggtggcggagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaaaaaggatggaaagatatcagataagtatgaagagggtgcagtattagaatcgtgttggccagacgttcacgacactggaaaatgcgatgttgatttattcgactggtgtcagggggatacgttcgatagaaacatatgccatcagtggatcggttcagcctttaataggagtgatagaactgtagagggtcaacaatcgttaataaatctgtataataagatgcaaacattatgtagtaaagatgctagtgtaccaatatgtgaatcatttttgcatcatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttgctaacacgtaattataataatttaggactttgcaatattgtacgatgtaataccagcgtgaacaacttacagatggataaaacttcctcattaagattgtcatgtggattaagcaatagtgatagattttctactgttcccgtcaatagagcaaaagtagttcaacataatattaaacattcgttcgacctaaaattgcatttgatcagtttattatctctcttggtaatatggatactaattgtagctatttaa

SEQ ID NO: 192 - protein, 340 aa, vaccinia virus
MGGGVSVELPKRDPPPGVPTDEMLLNVDKMHDVIAPAKLLEYVHIGPLAKDKEDKVKKRYPEFRLVNTGPGGLSALLRQSYNGTAPNCCRTFNRTHYWKKDGKISDKYEEGAVLESCWPDVHDTGKCDVDLFDWCQGDTFDRNICHQWIGSAFNRSDRTVEGQQSLINLYNKMQTLCSKDASVPICESFLHHLRAHNTEDSKEMIDYILRQQSADFKQKYMRCSYPTRDKLEESLKYAEPRECWDPECSNANVNFLLTRNYNNLGLCNIVRCNTSVNNLQMDKTSSLRLSCGLSNSDRFSTVPVNRAKVVQHNIKHSFDLKLHLISLLSLLVIWILIVAI

SEQ ID NO: 193 - DNA, 753 bp, vaccinia virus
  CDS (1)...(753)
atgggtgccgcggcaagcatacagacgacggtgaatacactcagcgaacgtatctcgtctaaattagaacaagaagcgaacgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtgccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaagcgttgatgcaattgacgactaaggccactactcaaatagcacctagacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactga

SEQ ID NO: 194 - protein, 250 aa, vaccinia virus
MGAAASIQTTVNTLSERISSKLEQEANASAQTKCDIEIGNFYIRQNHGCNLTVKNMCSADADAQLDAVLSAATETYSGLTPEQKAYVPAMFTAALNIQTSVNTVVRDFENYVKQTCNSSAVVDNKLKIQNVIIDECYGAPGSPTNLEFINTGSSKGNCAIKALMQLTTKATTQIAPRQVAGTGVQFYMIVIGVIILAALFMYYAKRMLFTSTNDKIKLILANKENVHWTTYMDTFFRTSPMVIATTDMQN

SEQ ID NO: 195 - DNA, 258 bp, vaccinia virus
  CDS (1)...(258)
atggaagttatcgctgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggtggtgctagtcatcacattaactattttttattactttatactataa

SEQ ID NO: 196 - protein, 85 aa, vaccinia virus
MEVIADRLDDIVKQNIADEKFVDFVIHGLEHQCPAILRPLIRLFIDILLFVIVIYIFTVRLVSRNYQMLLVVLVITLTIFYYFIL

SEQ ID NO: 197 - DNA, 1050 bp, vaccinia virus
  CDS (1)...(1050)
atgaatacccgtaccgatgttacaaacgataatatagacaaaaatccaaccaaacgaggtgatagaaatataccaggaagaaatgaaagatttaatgaccaaaatagattcaacaacgatataccaaagcctaaaccaagactacagcctaatcagccaccgaaacaagataataaatgcagagaagagaatggagattttatcaatattagattgtgtgcctacgagaaggaatattgcaatgacggatatctatctcctgcctattatatgttaaaacaggtggatgatgaagaaatgagttgctggtcagaactatcgtcgttggtgagatccagaaaggcggtgggatttcctctattaaaggcggctaaacgtatttctcatggatcgatgctatattttgaacagttcaaaaacagtaaagttgtgaaattaaccccgcaagttaaatgtttaaatgatactgttatttttcaaactgtagttattttatattccatgtataaacgtggcatatattctaacgaattttgttttaatctggtttctattcccagaacgaacattgttttttctgttaatcaattaatgtttaacatttgtacagacatattggtagttctatctatttgcggcaaccggctctatagaacaaatctaccacagtcgtgttacttaaatttcatacacggccatgagacaatagcccgtagaggatatgaacactccaattactttttcgagtggttgataaaaaatcacatatcgctattgaccaagcaaacgatggatattctcaaggtaaagaaaaagtatgctacaggagcaccagtaaataggttgttagaacctggtacactggtatatgtgcccaaagaagattattactttataggcatatcactcaccgatgtgtcaattagcgataatgtcagagtattattttccacagatggaatagtgttagaaatagaagactttaatatcaagcatttatttatggcaggtgagatgtttgttagaagtcagtctagtactattatagta

SEQ ID NO: 198 - protein, 350 aa, vaccinia virus
MNTRTDVTNDNIDKNPTKRGDRNIPGRNERFNDQNRFNNDIPKPKPRLQPNQPPKQDNKCREENGDFINIRLCAYEKEYCNDGYLSPAYYMLKQVDDEEMSCWSELSSLVRSRKAVGFPLLKAAKRISHGSMLYFEQFKNSKVVKLTPQVKCLNDTVIFQTVVILYSMYKRGIYSNEFCFNLVSIPRTNIVFSVNQLMFNICTDILVVLSICGNRLYRTNLPQSCYLNFIHGHETIARRGYEHSNYFFEWLIKNHISLLTKQTMDILKVKKKYATGAPVNRLLEPGTLVYVPKEDYYFIGISLTDVSISDNVRVLFSTDGIVLEIEDFNIKHLFMAGEMFVRSQSSTIIV

SEQ ID NO: 199 - DNA, 756 bp, vaccinia virus
  CDS (1)...(756)
atgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgaaaatatcacaggagcaatgtttaccacaatgtataatataagaaacaatttgggtctaggcgatgataaactaactattgaagccattgaaaactatttcttggatcctaacaatgaggttatgcctcttatcattaataatacggatatgactgccgtcattcctaaaaaaagtggtaggagaaagaataagaacatggttattttccgtcaaggatcatcacctatcttgtgtattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccatgagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattga

SEQ ID NO: 200 - protein, 251 aa, vaccinia virus
MSLLLENLIEEDTIFFAGSISEYDDLQMVIAGAKSKFPRSMLSIFNIVPRTMSKYELELIHNENITGAMFTTMYNIRNNLGLGDDKLTIEAIENYFLDPNNEVMPLIINNTDMTAVIPKKSGRRKNKNMVIFRQGSSPILCIFETRKKINIYKENMESASTEYTPIGDNKALISKYAGINVLNVYSPSTSMRLNAIYGFTNKNKLEKLSTNKELESYSSSPLQEPIRLNDFLGLLECVKKNIPLTDIPTKD

SEQ ID NO: 201 - DNA, 387 bp, vaccinia virus
  CDS (1)...(387)
atggagaatgttcctaatgtatactttaatcctgtgtttatagagcccacgtttaaacattctttattaagtgtttataaacacagattaatagttttatttgaagtattcgttgtattcattctaatatatgtattttttagatctgaattaaatatgttcttcatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatga

SEQ ID NO: 202 - protein, 128 aa, vaccinia virus
MENVPNVYFNPVFIEPTFKHSLLSVYKHRLIVLFEVFVVFILIYVFFRSELNMFFMPKRKIPDPIDRLRRANLACEDDKLMIYGLPWMTTQTSALSINSKPIVYKDCAKLLRSINGSQPVSLNDVLRR

SEQ ID NO: 203 - DNA, 462 bp, vaccinia virus
  CDS (1)...(462)
atggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagccgtgggtcattgttatgaatctctttcagaggaatacagacaattgacaaaattcacagactctcaagattttaaaaaactgtttaacaaggtccctattgttacagatggaagggtcaaacttaataaaggatatttgttcgactttgtgattagtttgatgcgattcaaaaaagaatcagctctagctaccaccgcaatagatcctgttagatacatagatcctcgtcgcgatatcgcattttctaacgtgatggatatattaaagtcgaataaagtgaacaataattaa

SEQ ID NO: 204 - protein, 153 aa, vaccinia virus
MDHNQYLLTMFFADDDSFFKYLASQDDESSLSDILQITQYLDFLLLLLIQSKNKLEAVGHCYESLSEEYRQLTKFTDSQDFKKLFNKVPIVTDGRVKLNKGYLFDFVISLMRFKKESALATTAIDPVRYIDPRRDIAFSNVMDILKSNKVNNN

SEQ ID NO: 205 - DNA, 534 bp, vaccinia virus
  CDS (1)...(534)
atgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgttgaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacatcgactcataa

SEQ ID NO: 206 - protein, 177 aa, vaccinia virus
MNGGHIQLIIGPMFSGKSTELIRRVRRYQIAQYKCVTIKYSNDNRYGTGLWTHDKNNFEALEATKLCDVLESITDFSVIGIDEGQFFPDIVEFCERMANEGKIVIVAALDGTFQRKPFNNILNLIPLSEMVVKLTAVCMKCFKEASFSKRLGEETEIEIIGGNDMYQSVCRKCYIDS

SEQ ID NO: 207 - DNA, 1002 bp, vaccinia virus
  CDS (1)...(1002)
atggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatctgctcccggtacacatatacgttatttgagagatcatttctataatttaggagtgatcatcaaatggatgctaattgacggccgccatcatgatcctattttaaatggattgcgtgatgtgactctagtgactcggttcgttgatgaggaatatctacgatccatcaaaaaacaactgcatccttctaagattattttaatttctgatgtgagatccaaacgaggaggaaatgaacctagtacggcggatttactaagtaattacgctctacaaaatgtcatgattagtattttaaaccccgtggcatctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaagtatctagcaaagattttatgtctaaaaacagaaatagcaagagatccgtacgcagtaataaatag

SEQ ID NO: 208 - protein, 333 aa, vaccinia virus
MDVVSLDKPFMYFEEIDNELDYEPESANEVAKKLPYQGQLKLLLGELFFLSKLQRHGILDGATVVYIGSAPGTHIRYLRDHFYNLGVIIKWMLIDGRHHDPILNGLRDVTLVTRFVDEEYLRSIKKQLHPSKIILISDVRSKRGGNEPSTADLLSNYALQNVMISILNPVASSLKWRCPFPDQWIKDFYIPHGNKMLQPFAPSYSAEMRLLSIYTGENMRLTRVTKLDAVNYEKKMYYLNKIVRNKVVVNFDYPNQEYDYFHMYFMLRTVYCNKTFPTTKAKVLFLQQSIFRFLNIPTTSTEKVSHEPIQRKVSSKDFMSKNRNSKRSVRSNK

SEQ ID NO: 209 - DNA, 558 bp, vaccinia virus
  CDS (1)...(558)
atgaaccaatacaacgtaaagtatctagcaaagattttatgtctaaaaacagaaatagcaagagatccgtacgcagtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggtgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaa

SEQ ID NO: 210 - protein, 185 aa, vaccinia virus
MNQYNVKYLAKILCLKTEIARDPYAVINRNVLLRYTTDIEYNDLVTLITVRHKIDSMKTVFQVFNESSINYTPVDDDYGEPIIITSYLQKGHNKFPVNFLYIDVVISDLFPSFVRLDTTETNIVNSVLQTGDGKKTLRLPKMLETEIVVKILYRPNIPLKIVRFFRNNMVTGVEIADRSVISVAD

SEQ ID NO: 211 - DNA, 399 bp, vaccinia virus
  CDS (1)...(399)
atgacggacgaacaaatttatgcattctgtgatgctaacaaagacgatatacgatgtaaatgtatttatcctgataaaagcatagtacggataggaatagatacaagattaccctattattgttggtacgagccatgtaaacgaagcgatgcgttgttaccagcctctttaaaaaaaaatataacaaaatgcaatgtatcggattgtaccatttcattgggaaacgtttccattacagatagtaaattagatgtaaataatgtttgtgattccaaacgagtagctaccgagaatatagctgtccgctatctgaatcaggaaattagataccctattatagatatcaaatggcttccgattggattactagcgttagctattttaatattagcatttttc

SEQ ID NO: 212 - protein, 133 aa, vaccinia virus
MTDEQIYAFCDANKDDIRCKCIYPDKSIVRIGIDTRLPYYCWYEPCKRSDALLPASLKKNITKCNVSDCTISLGNVSITDSKLDVNNVCDSKRVATENIAVRYLNQEIRYPIIDIKWLPIGLLALAILILAFF

SEQ ID NO: 213 - DNA, 3861 bp, vaccinia virus
  CDS (1)...(3861)
atggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaagacttgtgggaaaacggaattggaatgtttcggtcactggggtaaagtaagtatttataaaactcatatagttaagcctgaatttatttcagaaattattcgtttactgaatcatatatgtattcactgcggattattgcgttcacgagaaccgtattccgacgatattaacctaaaagagttatcgggacacgctcttaggagattaaaggataaaatattatccaagaaaaagtcatgttggaacagtgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgttgattattagaccggctattagtttttggatagatagtatacccaaagaaaccaatgaattaacttacttattaggtatgatcgttaagaattgtaacttgaatgctgatgaacaggttatccagaaggcggtaatagaatacgatgatattaaaattatttctaataacactaccagtattaatttatcatatatcacatccggcaaaaataatatgattagaagttatatcgtcgcccggcgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcatcaaaccaagttaaattttactttaataaacgattaaaccaattaacaagaatacgccaaggaaagtttattaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgatttcgacggggatgaggaatggatgatattagaacaaaatcctaaagctgtaattgaacaaagtattcttatgtatccgacgacgttactcaaacacgatattcatggagcccctgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcccacagaactaatgtatattctaggtacttatggacaacagaggattgatggtgaaccagcagagactcgagtattgggtagagttttaccttactatcttccagactctaaggatccagaaggaagaggttatattcttaattctttaacaaaaggattaacaggttctcaatattacttttcgatgctggttgcaagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaaaaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccaaacatcactcttcgaaaagaaacagataaatatgtagtagatataatagttaatagattatacatcaagagagcagaaataaccgaattagttgtcgaatatatgattgaacgatttatctcctttagcgtcattgtaaaggaatggggtatggagacattcattgaggacgaggataatattagatttactgtctatctaaatttcgttgaaccagaggaattgaatcttagtaagtttatgatggttcttccgggggcagccaacaagggaaagattagtaaattcaagattcctatctctgactatacgggatatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaa

SEQ ID NO: 214 - protein, 1286 aa, vaccinia virus
MAVISKVTYSLYDQKEINATDIIISHVKNDDDIGTVKDGRLGAMDGALCKTCGKTELECFGHWGKVSIYKTHIVKPEFISEIIRLLNHICIHCGLLRSREPYSDDINLKELSGHALRRLKDKILSKKKSCWNSECMQPYQKITFSKKKVCFVNKLDDINVPNSLIYQKLISIHEKFWPLLEIHQYPANLFYTDYFPIPPLIIRPAISFWIDSIPKETNELTYLLGMIVKNCNLNADEQVIQKAVIEYDDIKIISNNTTSINLSYITSGKNNMIRSYIVARRKDQTARSVIGPSTSITVNEVGMPAYIRNTLTEKIFVNAFTVDKVKQLLASNQVKFYFNKRLNQLTRIRQGKFIKNKIHLLPGDWVEVAVQEYTSIIFGRQPSLHRYNVIASSIRATEGDTIKISPGIANSQNADFDGDEEWMILEQNPKAVIEQSILMYPTTLLKHDIHGAPVYGSIQDEIVAAYSLFRIQDLCLDEVLNILGKYGREFDPKGKCKFSGKDIYTYLIGEKINYPGLLKDGEIIANDVDSNFVVAMRHLSLAGLLSDHKSNVEGINFIIKSSYVFKRYLSIYGFGVTFKDLRPNSTFTNKLEAINVEKIELIKEAYAKYLNDVRDGKIVPLSKALEADYVESMLSNLTNLNIREIEEHMRQTLIDDPDNNLLKMAKAGYKVNPTELMYILGTYGQQRIDGEPAETRVLGRVLPYYLPDSKDPEGRGYILNSLTKGLTGSQYYFSMLVARSQSTDIVCETSRTGTLARKIIKKMEDMVVDGYGQVVIGNTLIKYAANYTKILGSVCKPVDLIYPDESMTWYLEISALWNKIKQGFVYSQKQKLAKKTLAPFNFLVFVKPTTEDNAIKVKDLYDMIHNVIDDVREKYFFTVSNIDFMEYIFLTHLNPSRIRITKETAITIFEKFYEKLNYTLGGGTPIGIISAQVLSEKFTQQALSSFHTTEKSGAVKQKLGFNEFNNLTNLSKNKTEIITLVSDDISKLQSVKINFEFVCLGELNPNITLRKETDKYVVDIIVNRLYIKRAEITELVVEYMIERFISFSVIVKEWGMETFIEDEDNIRFTVYLNFVEPEELNLSKFMMVLPGAANKGKISKFKIPISDYTGYDDFNQTKKLNKMTVELMNLKELGSFDLENVNVYPGVWNTYDIFGIEAAREYLCEAMLNTYGEGFDYLYQPCDLLASLLCASYEPESVNKFKFGAASTLKRATFGDNKALLNAALHKKSEPINDNSSCHFFSKVPNIGTGYYKYFIDLGLLMRMERKLSDKISSQKIKEMEETEDF

SEQ ID NO: 215 - DNA, 513 bp, vaccinia virus
  CDS (1)...(513)
atggataagaaaagtttgtataaatacttactactacgttcaactggagatatgcacagagccaaatctcccactataatgacaagggtaaccaataatgtgtatttgggaaattataaaaatgctatggatgcaccatcatctgaagttaagttcaaatatgttttaaatttgacgatggataaatatacattacctaactctaatattaatattattcatataccgttggtagatgatacaactaccgatattagtaaatattttgacgacgtaaccgcctttttatctaaatgtgatcaacgaaacgagcccgtgttggttcattgtgctgcgggagtaaatagaagcggggctatgattttggcatatctaatgtctaaaaataaggagtcattgcctatgctatattttttatacgtgtatcattctatgagggacttgagaggcgcatttgtggaaaatccatcgtttaaaagacagatcatagaaaaatatgttattgataagaat

SEQ ID NO: 216 - protein, 171 aa, vaccinia virus
MDKKSLYKYLLLRSTGDMHRAKSPTIMTRVTNNVYLGNYKNAMDAPSSEVKFKYVLNLTMDKYTLPNSNINIIHIPLVDDTTTDISKYFDDVTAFLSKCDQRNEPVLVHCAAGVNRSGAMILAYLMSKNKESLPMLYFLYVYHSMRDLRGAFVENPSFKRQIIEKYVIDKN

SEQ ID NO: 217 - DNA, 570 bp, vaccinia virus
  CDS (1)...(570)
atggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatattcgaattcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatag

SEQ ID NO: 218 - protein, 189 aa, vaccinia virus
MDKTTLSVNACNLEYVREKAIVGVQAAKTSTLIFFVIILAISALLLWFQTSDNPVFNELTRYMRIKNTVNDWKSLTDSKTKLESDRGRLLAAGKDDIFEFKCVDFGAYFIAMRLDKKTYLPQAIRRGTGDAWMVKKAAKVDPSAQQFCQYLIKHKSNNVITCGNEMLNELGYSGYFMSPHWCSDFSNME

SEQ ID NO: 219 - DNA, 972 bp, vaccinia virus
  CDS (1)...(972)
atggcggcggtgaaaactcctgttattgttgtgccagttattgatagacctccatcagaaacatttcctaatgttcatgagcatattaatgatcagaagttcgatgatgtaaaggacaacgaagttatgccagaaaaaagaaatgttgtggtagtcaaggatgatccagatcattacaaggattatgcgtttatacagtggactggaggaaacattagaaatgatgacaagtatactcacttcttttcagggttttgtaacactatgtgtacagaggaaacgaaaagaaatatcgctagacatttagccctatgggattctaatttttttaccgagttagaaaataaaaaggtagaatatgtagttattgtagaaaacgataacgttattgaggatattacgtttcttcgtcccgtcttgaaggcaatgcatgacaaaaaaatagatatcctacagatgagagaaattattacaggcaataaagttaaaaccgagcttgtaatggacaaaaatcatgccatattcacatatacaggagggtatgatgttagcttatcagcctatattattagagttactacggcgctgaacatcgtagatgaaattataaagtctggaggtctatcatcgggattttattttgaaatagccagaatcgaaaacgaaatgaagatcaataggcagatactggataacgccgccaaatatgtagaacacgatccccgacttgttgcagaacaccgcttcgaaaacatgaaaccgaatttttggtctagaataggaacggcagctgctaaacgttatccaggagttatgtacgcgtttactactccactgatttcattttttggattgtttgatattaatgttataggtttgattgtaattttgtttattatgtttatgctcatctttaacgttaaatctaagctgttatggttccttacaggaacattcgttaccgcatttatc

SEQ ID NO: 220 - protein, 324 aa, vaccinia virus
MAAVKTPVIVVPVIDRPPSETFPNVHEHINDQKFDDVKDNEVMPEKRNVVVVKDDPDHYKDYAFIQWTGGNIRNDDKYTHFFSGFCNTMCTEETKRNIARHLALWDSNFFTELENKKVEYVVIVENDNVIEDITFLRPVLKAMHDKKIDILQMREIITGNKVKTELVMDKNHAIFTYTGGYDVSLSAYIIRVTTALNIVDEIIKSGGLSSGFYFEIARIENEMKINRQILDNAAKYVEHDPRLVAEHRFENMKPNFWSRIGTAAAKRYPGVMYAFTTPLISFFGLFDINVIGLIVILFIMFMLIFNVKSKLLWFLTGTFVTAFI

SEQ ID NO: 221 - DNA, 2385 bp, vaccinia virus
  CDS (1)...(2385)
atggactctaaagagactattctaattgagatcattccaaaaataaaagcatatctactagacgcgaatataagtccaaaatcctacgatgactttatttcacgaaataaaaatattttcgttatcaacctttataacgtatcgactatcacagaagaagatatacgattgttatacactacgatagaacagaatattgacgcggatgatcaaacactggttgctattttttcgtatataggatataaatttgaacaggctgttaaagaagagattagtacgagtttatccttcaatgacaagaataccacagatgaaatgacgtataacttgtatgatcttttttttaacacattagacatgtatttacgacaaaagaagatcagtattctggtaaatgatgatgttagaggtgatgtaatcgttagttataaaaatagtgacttagtttcatcatttaatgcggaactagaaccagagattaagaagataccgttcaatatgaaaaatctattaccgtacttggaaaagaatttggaccaactaagattctctaaaaaatatttagactttgcatatttatgtagacacatcggtattcccatttccaaaaaaaagtataatgtgcgatatgtatttctttataaaatagacggattatccattcctattatcattaaggattttttagatgttaagtacgtatatttggaaaatactggaaaaatttataaaaattctttttccgaagaccataacaacagtctatctgattggggtaaagttattatacctctcttaaaggatcgtcatctatatagctacatctttctatctagttatcatttacatagttactatacagatctcatcgcgagagacgagcctgtgtttgtgaaacgcaaaaaactagatattatagagatcgatgaacctgaggcatggaaaagggatgttagagtggaattcgcaccgtgtgagcatcaaattagattgaaggaagctatgaaagttgacgctaactatttcactaaaattaataattttgctaacgaatttatttattatgaagatggtgtggcatattgtagagtgtgtggaataaatatacctatatttaatttagatgccgctgacgtgattaaaaatacagttatcgtttccacgtttaacaagactatattcttgagcgaaccatatagctatttcgttcatagtcagcgctttatctttaatattatcatgtcttttgataatattatgaaatctcaaacttgggtaatgaaatacaacattaaccgactaattcttaactttcttattgatataaactctagacgtcaggaatacgaaaaaaagttttcttctgaaattaagagaggtctgttctttcttcgtttgtctgcaaacttattcgaaagtcaagtatcgtctacagagttattttatgtttccaaaatgcttaatttgaactatatagttgcgttagtaatcattcttaacagtagtgcggactttatagtttcctatatgacatccaagaacaaaacggtagaagaatccactcttaaatacgccatctccgtggttatatacgattttttggttaagactagaatttgcgagaagggatcgttggatactatagttttatttaccgatgtatacacatctataatgccggaggaattggatttacattttcagagaatcacattagaacttagaaaactagtatccattcagagatcggcgttagaacccaattacgatgtagaaagtcgcggcgaagagcttccgctatctgcattaaagtttttcgatacaagcaccattatagttaaaacaatggctccagtacatacatgtgtagaacaaaaaattgttgcacctactccatctgtagaaccaactgatgcatctcttaaaaacttcaaagagctaacgtgtgacgaagatattaagattttgattagagttcatgatactaatgctacaaaattagtcatttttccatcacatctaaaaatagaaattgagagaaaaaaactaattataccgctaaagagtttatatattaccaatactctcaaatattattattctaactcctatttatacgttttcagattcggagatcctatgccattcgaagaagaactcatagatcacgaacatgtgcaatacaaaataaattgttacaatattctaagatatcatttattgccagacagtgacgtgtttgtatattttagtaattcattaaacagagaagcattggaatacgcattttatatctttttgtcgaaatatgtaaatgtgaaacaatggatagacgaaaatataactcgtattaaagagttgtatatgattaatttcaataac

SEQ ID NO: 222 - protein, 795 aa, vaccinia virus
MDSKETILIEIIPKIKAYLLDANISPKSYDDFISRNKNIFVINLYNVSTITEEDIRLLYTTIEQNIDADDQTLVAIFSYIGYKFEQAVKEEISTSLSFNDKNTTDEMTYNLYDLFFNTLDMYLRQKKISILVNDDVRGDVIVSYKNSDLVSSFNAELEPEIKKIPFNMKNLLPYLEKNLDQLRFSKKYLDFAYLCRHIGIPISKKKYNVRYVFLYKIDGLSIPIIIKDFLDVKYVYLENTGKIYKNSFSEDHNNSLSDWGKVIIPLLKDRHLYSYIFLSSYHLHSYYTDLIARDEPVFVKRKKLDIIEIDEPEAWKRDVRVEFAPCEHQIRLKEAMKVDANYFTKINNFANEFIYYEDGVAYCRVCGINIPIFNLDAADVIKNTVIVSTFNKTIFLSEPYSYFVHSQRFIFNIIMSFDNIMKSQTWVMKYNINRLILNFLIDINSRRQEYEKKFSSEIKRGLFFLRLSANLFESQVSSTELFYVSKMLNLNYIVALVIILNSSADFIVSYMTSKNKTVEESTLKYAISVVIYDFLVKTRICEKGSLDTIVLFTDVYTSIMPEELDLHFQRITLELRKLVSIQRSALEPNYDVESRGEELPLSALKFFDTSTIIVKTMAPVHTCVEQKIVAPTPSVEPTDASLKNFKELTCDEDIKILIRVHDTNATKLVIFPSHLKIEIERKKLIIPLKSLYITNTLKYYYSNSYLYVFRFGDPMPFEEELIDHEHVQYKINCYNILRYHLLPDSDVFVYFSNSLNREALEYAFYIFLSKYVNVKQWIDENITRIKELYMINFNN

SEQ ID NO: 223 - DNA, 612 bp, vaccinia virus
  CDS (1)...(612)
atggcgtggtcaattacaaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcggcgacattgtagaaagcgtggctgctgtagagctcgatgatagcgacggggatgatgaacctatggtacaagttgaagctggtaaagtaaatcatagtgctagaagcgatctttctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaa

SEQ ID NO: 224 - protein, 203 aa, vaccinia virus
MAWSITNKADTSSFTKMAEIRAHLKNSAENKDKNEDIFPEDVIIPSTKPKTKRATTPRKPAATKRSTKKEEVEEEVVIEEYHQTTEKNSPSPGVGDIVESVAAVELDDSDGDDEPMVQVEAGKVNHSARSDLSDLKVATDNIVKDLKKIITRISAVSTVLEDVQAAGISRQFTSMTKAITTLSDLVTEGKSKVVRKKVKTCKK

SEQ ID NO: 225 - DNA, 945 bp, vaccinia virus
  CDS (1)...(945)
atgcgtgcacttttttataaagatggtaaactctttaccgataataattttttaaatcctgtattagatgataatccagcgtatgaggttttgcaacatgttaaaattcctactcatttaacagatgtagtagtatatgaacaaacgtgggaagaggcattaactagattaatttttgtgggaagcgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccgtcaccaaaaaagttaatagcattaactatcaaacaaactgctgaagttgtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatga

SEQ ID NO: 226 - protein, 314 aa, vaccinia virus
MRALFYKDGKLFTDNNFLNPVLDDNPAYEVLQHVKIPTHLTDVVVYEQTWEEALTRLIFVGSDSKGRRQYFYGKMHVQNRNAKRDRIFVRVYNVMKRINCFINKNIKKSSTDSNYQLAVFMLMETMFFIRFGKMKYLKENETVGLLTLKNKHIEISPDEIVIKFVGKDKVSHEFVVHKSNRLYKPLLKLTDDSSPEEFLFNKLSERKVYECIKQFGIRIKDLRTYGVNYTFLYNFWTNVKSISPLPSPKKLIALTIKQTAEVVGHTPSISKRAYMATTILEMVKDKNFLDVVSKTTFDEFLSIVVDHVKSSTDG

SEQ ID NO: 227 - DNA, 441 bp, vaccinia virus
  CDS (1)...(441)
atggaaatggataagcgtataaaatctctcgcaatgaccgctttctttggggagctaagcacattagatattatggcattgataatgtctatatttaaacgccatccaaacaataccattttttcagtggataaggatggtcagtttatgattgatttcgaatacgataattataaggcttctcaatatttggatctgaccctcactccgatatttggagatgaatgcaagactcacgcatcgagtatagccgaacaattggcgtgtgcggatattattaaagaggatattagcgaatacatcaaaactactccccgtcttaaacgatttataaaaaaataccgcaatagatcagatactcgtatcagtcgagatacagaaaagcttaaaatagctctagctaaaggcatagattacgaatatataaaagacgcttgttaa

SEQ ID NO: 228 - protein, 146 aa, vaccinia virus
MEMDKRIKSLAMTAFFGELSTLDIMALIMSIFKRHPNNTIFSVDKDGQFMIDFEYDNYKASQYLDLTLTPIFGDECKTHASSIAEQLACADIIKEDISEYIKTTPRLKRFIKKYRNRSDTRISRDTEKLKIALAKGIDYEYIKDAC

SEQ ID NO: 229 - DNA, 2535 bp, vaccinia virus
  CDS (1)...(2535)
atggatgccaacgtagtatcatcttctactattgcaacgtatatagacgctttagcgaagaatgcttcagaattagaacagaggtctaccgcatacgaaataaataatgaattggaactagtatttattaagccgccattaattactttgacaaatgtagtgaatatctctacgattcaggaatcgtttattcgatttaccgttactaataaggaaggtgtcaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccaatctaaaagttctttgttgcacgctattaatcatccaaagtcaaggcctaatacatctctggaaatagaattcacacctagagacaatgaaacagttccatatgatgaactaataaaggaattgacgactctctcgcgtcatatatttatggcttctccagagaatgtaattctttctccgcctattaacgcgcctataaaaacctttatgttgcctaaacaagatatagtaggtttggatctggaaaatctatatgccgtaactaagactgacggcattcctataactatcagagttacatcaaacgggttgtattgttattttacacatcttggttatattattagatatcctgttaagagaataatagattccgaagtagtagtctttggtgaggcagttaaggataagaactggactgtatatctcattaagctaatagagcccgtgaatgctatcagtgatagactagaagaaagtaagtatgttgaatctaaactagtggatatttgtgatcggatagtattcaagtcaaagaaatacgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaa

SEQ ID NO: 230 - protein, 844 aa, vaccinia virus
MDANVVSSSTIATYIDALAKNASELEQRSTAYEINNELELVFIKPPLITLTNVVNISTIQESFIRFTVTNKEGVKIRTKIPLSKVHGLDVKNVQLVDAIDNIVWEKKSLVTENRLHKECLLRLSTEERHIFLDYKKYGSSIRLELVNLIQAKTKNFTIDFKLKYFLGSGAQSKSSLLHAINHPKSRPNTSLEIEFTPRDNETVPYDELIKELTTLSRHIFMASPENVILSPPINAPIKTFMLPKQDIVGLDLENLYAVTKTDGIPITIRVTSNGLYCYFTHLGYIIRYPVKRIIDSEVVVFGEAVKDKNWTVYLIKLIEPVNAISDRLEESKYVESKLVDICDRIVFKSKKYEGPFTTTSEVVDMLSTYLPKQPEGVILFYSKGPKSNIDFKIKKENTIDQTANVVFRYMSSEPIIFGESSIFVEYKKFSNDKGFPKEYGSGKIVLYNGVNYLNNIYCLEYINTHNEVGIKSVVVPIKFIAEFLVNGEILKPRIDKTMKYINSEDYYGNQHNIIVEHLRDQSIKIGDIFNEDKLSDVGHQYANNDKFRLNPEVSYFTNKRTRGPLGILSNYVKTLLISMYCSKTFLDDSNKRKVLAIDFGNGADLEKYFYGEIALLVATDPDADAIARGNERYNKLNSGIKTKYYKFDYIQETIRSDTFVSSVREVFYFGKFNIIDWQFAIHYSFHPRHYATVMNNLSELTASGGKVLITTMDGDKLSKLTDKKTFIIHKNLPSSENYMSVEKIADDRIVVYNPSTMSTPMTEYIIKKNDIVRVFNEYGFVLVDNVDFATIIERSKKFINGASTMEDRPSTKNFFELNRGAIKCEGLDVEDLLSYYVVYVFSKR

SEQ ID NO: 231 - DNA, 438 bp, vaccinia virus
  CDS (1)...(438)
atgtccatcaatatcgatataaaaaaaataactgatttactcaacagtagtattttattcccagatgatgtgcaagaacttcttcgagagaaatatatagtattagaaagaaaatcaaatggtacacctacagtagctcacatctataagacaatggctagatttgataataagagtatatatagaatcgccaagtttttatttatgaacaggccagatgttatcaaacttttatttttagaagacgtagaacctctgttacccgacaaaagtattaatatatctattaacaatacagagtatccacagttggaaggtcctataggaacaaaaatcgctctattggaattatttaatgcatttagaacggggatatcagaacccataccatattattatttaccgcttagaaaagacataaacaacatagtaactaag

SEQ ID NO: 232 - protein, 146 aa, vaccinia virus
MSINIDIKKITDLLNSSILFPDDVQELLREKYIVLERKSNGTPTVAHIYKTMARFDNKSIYRIAKFLFMNRPDVIKLLFLEDVEPLLPDKSINISINNTEYPQLEGPIGTKIALLELFNAFRTGISEPIPYYYLPLRKDINNIVTK

SEQ ID NO: 233 - DNA, 711 bp, vaccinia virus
  CDS (1)...(711)
atggacatttttatagttaaggataataagtatcccaaagtcgataacgacgataacgaagtatttatacttttaggaaatcacaatgactttatcagattaaaattaacaaaattaaaggagcatgtatttttttctgaatatattgtgactccagatacatatggatctttatgcgtcgaattaaatgggtctagttttcagcacggcggtagatatatagaggtggaggaatttatagatgctggaagacaagttagatggtgttctacatccaatcatatatctaaagatatacccgaagatatgcacactgataaatttgtcatttatgatatttatacgtttgattcgttcaagaataaacgattggtattcgtacaggtgcctccatcattaggagatgatagctatttgactaatccgttattgtctccgtattatcgtaattcagtagccagacaaatggtcaatgatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgata

SEQ ID NO: 234 - protein, 237 aa, vaccinia virus
MDIFIVKDNKYPKVDNDDNEVFILLGNHNDFIRLKLTKLKEHVFFSEYIVTPDTYGSLCVELNGSSFQHGGRYIEVEEFIDAGRQVRWCSTSNHISKDIPEDMHTDKFVIYDIYTFDSFKNKRLVFVQVPPSLGDDSYLTNPLLSPYYRNSVARQMVNDMIFNQDSFLKYLLEHLIRSHYRVSKHITIVRYKDTEELNLTRICYNRDKFKAFVFAWFNGVSENEKVLDTYKKVSNLI

SEQ ID NO: 235 - DNA, 657 bp, vaccinia virus
  CDS (1)...(657)
atgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgcggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatctactgggataagatttccaagttactgctgcagcatataactaaacacgttagtgttctttattgtttgggtaaaacagatttctcgaatatacgggccaagttagaatccccggtaactaccatagtcggatatcatccagcggctagagaccgccaattcgagaaagatagatcatttgaaattatcaacgttttactggaattagacaacaaggcacctataaattgggctcaagggtttatttattaa

SEQ ID NO: 236 - protein, 218 aa, vaccinia virus
MNSVTVSHAPYTITYHDDWEPVMSQLVEFYNEVASWLLRDETSPIPDKFFIQLKQPLRNKRVCVCGIDPYPKDGTGVPFESPNFTKKSIKEIASSISRLTGVIDYKGYNLNIIDGVIPWNYYLSCKLGETKSHAIYWDKISKLLLQHITKHVSVLYCLGKTDFSNIRAKLESPVTTIVGYHPAARDRQFEKDRSFEIINVLLELDNKAPINWAQGFIY

SEQ ID NO: 237 - DNA, 2358 bp, vaccinia virus
  CDS (1)...(2358)
atggatgcaactattagaggtaatgatgttatttttgtccttaagactataggtgtcccatcagcatgtagacaaaatgaagatccaagattcgtagaagcatttaaatgcgacgagttaaaaagatatattgagaataatccagaatgtacactattcgaaagtcttagggatgaggaagcatactctatagtcagaattttcatggatgtagatttagacgcgtgtctagacgaaatagattatttaacggctattcaagattttattatcgaggtgtcaaactgtgtagctagattcgcgtttacagaatgcggtgccattcatgaaaatgtaataaaatccatgagatctaatttttcattgactaagtctacaaatagagataaaacaagttttcatattatctttttagacacgtataccactatggatacattgatagctatgaaacgaacactattagaattaagtagatcatctgaaaatccactaacaagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacgacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccaagaaaacgaaagactgtagaagctaacatacgagacatgttagtagattcagtggagaccgatacctatccggataaacttccgtttaaaaatggtgtattggacctggtagacggaatgttttactctggagataatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagttgtacgaaaaaactttatctagttgtttatgcggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgacaatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatagatatagattcgcatttctatacttgttggtgaaatggtacagaaaatatcatgttcctattatgaaactatatcctacaccggaagagattccggactttgcattctatctcaaaataggtactctgttggtatctagctctgtaaagcatattccattaatgacggacctctccaaaaagggatatatattgtacgataatgtggtcactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaa

SEQ ID NO: 238 - protein, 785 aa, vaccinia virus
MDATIRGNDVIFVLKTIGVPSACRQNEDPRFVEAFKCDELKRYIENNPECTLFESLRDEEAYSIVRIFMDVDLDACLDEIDYLTAIQDFIIEVSNCVARFAFTECGAIHENVIKSMRSNFSLTKSTNRDKTSFHIIFLDTYTTMDTLIAMKRTLLELSRSSENPLTRSIDTAVYRRKTTLRVVGTRKNPNCDTIHVMQPPHDNIEDYLFTYVDMNNNSYYFSLQRRLEDLVPDKLWEPGFISFEDAIKRVSKIFINSIINFNDLDENNFTTVPLVIDYVTPCALCKKRSHKHPHQLSLENGAIRIYKTGNPHSCKVKIVPLDGNKLFNIAQRILDTNSVLLTERGDHIVWINNSWKFNSEEPLITKLILSIRHQLPKEYSSELLCPRKRKTVEANIRDMLVDSVETDTYPDKLPFKNGVLDLVDGMFYSGDNAKKYTCTVSTGFKFDDTKFVEDSPEMEELMNIINDIQPLTDENKKNRELYEKTLSSCLCGATKGCLTFFFGETATGKSTTKRLLKSAIGDLFVETGQTILTDVLDKGPNPFIANMHLKRSVFCSELPDFACSGSKKIRSDNIKKLTEPCVIGRPCFSNKINNRNHATIIIDTNYKPVFDRIDNALMRRIAVVRFRTHFSQPSGREAAENNDAYDKVKLLDEGLDGKIQNNRYRFAFLYLLVKWYRKYHVPIMKLYPTPEEIPDFAFYLKIGTLLVSSSVKHIPLMTDLSKKGYILYDNVVTLPLTTFQQKISKYFNSRLFGHDIESFINRHKKFANVSDEYLQYIFIEDISSP

SEQ ID NO: 239 - DNA, 1914 bp, vaccinia virus
  CDS (1)...(1914)
atgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgccgaacatcaacatcttaaaaattttcaattataatatgggtgtagctatgaacttgtttaatgacaaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttttactattgtctggatctcccattactaacacacctaatactctgggtcatattatagatttaatgtccgaagagacgatagattttggtgaaattattagtcgtggtaagaaagtaattcagacacttcttaacgaacgcggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttatcaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggcagtcaattgatgtttttgttttcgtcaaacattatgtccgaatcctatactctgaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtgacgtcattaaacgattacacacaggatgaattaattaatgttttaccatttgacatcaaaaagctgttatatctaaaatttaagacgaaagaaacgaatagaatatactctattcttcaagagatgtctgaaacgtattctcttccaccacatccatcaattgtaaaagttttattgggagaattggtcagacaatttttttataataattctcgtattaagtataacgactccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataa

SEQ ID NO: 240 - protein, 637 aa, vaccinia virus
MNTGIIDLFDNHVDSIPTILPHQLATLDYLVRTIIDENRSVLLFHIMGSGKTIIALLFALVASRFKKVYILVPNINILKIFNYNMGVAMNLFNDKFIAENIFIHSTTSFYSLNYNDNVINYNGLSRYNNSIFIVDEAHNIFGNNTGELMTVIKNKNKIPFLLLSGSPITNTPNTLGHIIDLMSEETIDFGEIISRGKKVIQTLLNERGVNVLKDLLKGRISYYEMPDKDLPTIRYHGRKFLDTRVVYCHMSKLQERDYMITRRQLCYHEMFDKNMYNVSMAVLGQLNLMNNLDTLFQEQDKELYPNLKINNGVLYGEELVTLNISSKFKYFINRIQTLNGKHFIYFSNSTYGGLVIKYIMLSNGYSEYNGSQGTNPHMINGKPKTFAIVTSKMKSSLEDLLDVYNSPENDDGSQLMFLFSSNIMSESYTLKEVRHIWFMTIPDTFSQYNQILGRSIRKFSYADISEPVNVYLLAAVYSDFNDEVTSLNDYTQDELINVLPFDIKKLLYLKFKTKETNRIYSILQEMSETYSLPPHPSIVKVLLGELVRQFFYNNSRIKYNDSKLLKMVTSVIKNKEDARNYIDDIVNGHFFVSNKVFDKSLLYKYENDIITVPFRLSYEPFVWGVNFRKEYNVVSSP

SEQ ID NO: 241 - DNA, 486 bp, vaccinia virus
  CDS (1)...(486)
atgtcgagctttgttaccaatggataccttccagttacattggaacctcatgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgtcgactcataa

SEQ ID NO: 242 - protein, 161 aa, vaccinia virus
MSSFVTNGYLPVTLEPHELTLDIKTNIRNAVYKTYLHREISGKMAKKIEIREDVELPLGEIVNNSVVINVPCVITYAYYHVGDIVRGTLNIEDESNVTIQCGDLICKLSRDSGTVSFSDSKYCFFRNGNAYDNGSEVTAVLMEAQQGIESSFVFLANIVDS

SEQ ID NO: 243 - DNA, 912 bp, vaccinia virus
  CDS (1)...(912)
atgccgcaacaactatctcctattaatatagaaactaaaaaagcaatttctaacgcgcgattgaagccgttagacatacattataatgagtcgaaaccaaccactatccagaacactggaaaactagtaaggattaattttaaaggaggatatataagtggagggtttctccccaatgaatatgtgttatcatcactacatatatattggggaaaggaagacgattatggatccaatcacttgatagatgtgtacaaatactctggagagattaatcttgttcattggaataagaaaaaatatagttcttatgaagaggcaaaaaaacacgatgatggacttatcattatttctatattcttacaagtattggatcataaaaatgtatattttcaaaagatagttaatcaattggattccattagatccgccaatacgtctgcaccgtttgattcagtattttatctagacaatttgctgcctagtaagttggattattttacatatctaggaacaactatcaaccactctgcagacgctgtatggataatttttccaacgccaataaacattcattctgatcaactatctaaattcagaacactattgtcgttgtctaatcatgagggcaaaccgcattatataacagagaactatagaaatccgtataaattgaacgatgacacagaagtatattattctggggagattatacgagcagcaactacctctccagcgcgcgagaactattttatgagatggttgtccgatttgagagagacatgtttttcatattatcaaaaatatatcgaagggaataaaacattcgcaattattgccatagtattcgtgtttatacttaccgctattctcttttttatgagtcgacgatattcgcgagaaaaacaaaac

SEQ ID NO: 244 - protein, 304 aa, vaccinia virus
MPQQLSPINIETKKAISNARLKPLDIHYNESKPTTIQNTGKLVRINFKGGYISGGFLPNEYVLSSLHIYWGKEDDYGSNHLIDVYKYSGEINLVHWNKKKYSSYEEAKKHDDGLIIISIFLQVLDHKNVYFQKIVNQLDSIRSANTSAPFDSVFYLDNLLPSKLDYFTYLGTTINHSADAVWIIFPTPINIHSDQLSKFRTLLSLSNHEGKPHYITENYRNPYKLNDDTEVYYSGEIIRAATTSPARENYFMRWLSDLRETCFSYYQKYIEGNKTFAIIAIVFVFILTAILFFMSRRYSREKQN

SEQ ID NO: 245 - DNA, 642 bp, vaccinia virus
  CDS (1)...(642)
atgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatga

SEQ ID NO: 246 - protein, 213 aa, vaccinia virus
MGITMDEEVIFETPRELISIKRIKDIPRSKDTHVFAACITSDGYPLIGARRTSFAFQAILSQQNSDSIFRVSTKLLRFMYYNELREIFRRLRKGSINNIDPHFEELILLGGKLDKKESIKDCLRRELKEESDERITVKEFGNVILKLTTRDKLFNKVYISYCMACFINQSLEDLSHTSIYNVEIRKIKSLNDCINDDKYEYLSYIYNMLVNSK

SEQ ID NO: 247 - DNA, 747 bp, vaccinia virus
  CDS (1)...(747)
atgaacttttacagatctagtataattagtcagattattaagtataatagacgactagctaagtctattatttgcaaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtttagaaagaaacgattatttctgaattattccaattatttgtccaaacaggaaagaagtatactatcgtcatttttttctctatatccagctactgctgataatgatagaatagacgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctctaacgagtgatcaaatcattgatacatttaaaagtaatcatgaaatcaaggatctaatatttttagatccgaattcaggtaatggactacaatacgaaattgcaaaatatgctctagatactgcaaaacttaaatgttacggccatagaggatgttattacgaatcattaaaaaaattaactgaggatgattga

SEQ ID NO: 248 - protein, 248 aa, vaccinia virus
MNFYRSSIISQIIKYNRRLAKSIICKDDSQIITLTAFVNQCLWCHKRVSVSAILLTTDNKILVCNRRDSFLYSEIIRTRNMFRKKRLFLNYSNYLSKQERSILSSFFSLYPATADNDRIDAIYPGGIPKRGENVPECLSREIKEEVNIDNSFVFIDTRFFIHGIIEDTIINKFFEVIFFVGRISLTSDQIIDTFKSNHEIKDLIFLDPNSGNGLQYEIAKYALDTAKLKCYGHRGCYYESLKKLTEDD

SEQ ID NO: 249 - DNA, 1893 bp, vaccinia virus
  CDS (1)...(1893)
atgagtaaatcacacgcggcctatatcgattatgcattgcgcagaactactaatatgcctgttgaaatgatgggaacagacgtagtacgcctcaaggattatcaacattttgtagcaagagttttcttaggattagacagtatgcattctcttttattgttccatgaaacgggtgtcggtaaaacaatgactactgtatatattctcaaacatcttaaggatatttatacgaattgggctattatcttattggtgaaaaaggctttgatagaagatccttggatgaacactatactcagatacgctccagagataacgaaggattgtatttttattaattacgatgatcaaaattttagaaataaattttttactaatatcaaaactattaattccaagagtagaatatgcgtcattattgatgaatgtcataacttcatttctaaatcattaatcaaagaagatggtaagatccgtcctactcgttcagtatataattttttatccaagaccatcgcattaaaaaaccataagatgatttgtttatcggctacacctatcgtcaatagtgtgcaagaattcaccatgttggttaacttactacgaccaggatccttacaacaccaatcactatttgagaataaacgtctagtcgatgaaaaagaattagtctccaaactaggaggactatgttcgtatatagttaataacgagttttctatttttgatgacgtagaagggtctgcatcattcgctaagaaaacagtattaatgcgatacgttaatatgtcgaaaaagcaagaagaaatttatcaaaaggctaaactcgctgaaataaaaacaggtatatcatcatttagaattctgagacgtatggctactacgtttacgttcgatagctttcctgaaagacaaaatcgtgatccgggcgaatacgcgcaagagatagcaacactatataatgattttaaaaattcattaagagatagagagttttctaaatccgcattagatacctttaaaaagggagaactattgaaaggggatgctagtgcggctgatatctctctatttactgaattaaaagagaaaagcgtcaaatttatagatgtatgtttgggaatattagcatcccatggtaaatgtctagtctttgaaccatttgttaatcagtcaggaatagaaatcttattactatatttcaaagtctttggtatctctaatatagagttctcatctagaacaaaagatactagaatcaaggcggtggctgagtttaaccaagaatcaaacactaacggagaatgcattaaaacatgcgtattctcttctagtggaggcgagggtattagttttttctcaattaatgatatcttcattttagatatgacatggaacgaggcgtctcttcgtcagatagtaggaagagccattcgtctcaatagtcacgttcttactcctccagaacgtagatatgtaaacgtgcactttataatggctagattatctaatggtatgcctactgtagacgaagacctatttgaaatcattcaaagcaaatcaaaagaatttgtccaattgtttagagtgtttaaacatacatcattagaatggattcatgctaatgaaaaagacttctcaccgatcgacaatgagtccggttggaaaaccttggtttcaagagccatcgatctatcgtctaaaaaaaatattaccaataaactaattgagggtactaatatttggtattccaattctaatagattaatgtcaataaatagaggatttaaaggcgtagatggtcgagtatacgatgtagacggtaactatctacatgatatgccggacaatcccgttataaaaatacacgatggtaaattaatttatattttc

SEQ ID NO: 250 - protein, 631 aa, vaccinia virus
MSKSHAAYIDYALRRTTNMPVEMMGTDVVRLKDYQHFVARVFLGLDSMHSLLLFHETGVGKTMTTVYILKHLKDIYTNWAIILLVKKALIEDPWMNTILRYAPEITKDCIFINYDDQNFRNKFFTNIKTINSKSRICVIIDECHNFISKSLIKEDGKIRPTRSVYNFLSKTIALKNHKMICLSATPIVNSVQEFTMLVNLLRPGSLQHQSLFENKRLVDEKELVSKLGGLCSYIVNNEFSIFDDVEGSASFAKKTVLMRYVNMSKKQEEIYQKAKLAEIKTGISSFRILRRMATTFTFDSFPERQNRDPGEYAQEIATLYNDFKNSLRDREFSKSALDTFKKGELLKGDASAADISLFTELKEKSVKFIDVCLGILASHGKCLVFEPFVNQSGIEILLLYFKVFGISNIEFSSRTKDTRIKAVAEFNQESNTNGECIKTCVFSSSGGEGISFFSINDIFILDMTWNEASLRQIVGRAIRLNSHVLTPPERRYVNVHFIMARLSNGMPTVDEDLFEIIQSKSKEFVQLFRVFKHTSLEWIHANEKDFSPIDNESGWKTLVSRAIDLSSKKNITNKLIEGTNIWYSNSNRLMSINRGFKGVDGRVYDVDGNYLHDMPDNPVIKIHDGKLIYIF

SEQ ID NO: 251 - DNA, 864 bp, vaccinia virus
  CDS (1)...(864)
atggatgaaattgtaaaaaatatccgggagggaacgcatgtccttcttccattttatgaaacattgccagaacttaatctgtctctaggtaaaagcccattacctagtctggaatacggagctaattactttcttcagatttctagagttaatgatctaaatagaatgccgaccgacatgttaaaactttttacacatgatatcatgttaccagaaagcgatctagataaagtctatgaaattttaaagattaatagcgtaaagtattatgggaggagtactaaagcggacgccgtagttgccgacctcagcgcacgcaataaactgttcaaacgtgaacgagatgctattaaatctaataatcatctcactgaaaacaatctatacattagcgattataagatgttaaccttcgacgtgtttcgaccattatttgattttgtaaacgaaaaatattgtattattaaacttccaactttattcggtagaggtgtaatcgatactatgagaatatattgtagtctctttaaaaatgttagactgctaaaatgcgtaagcgatagctggttgaaagatagcgccattatggtggctagtgatgtttgtaaaaaaaatttggatttatttatgtctcatgttaagtccgtcactaagtcttcttcttggaaggatgtgaacagtgttcaatttagtattttaaacaatccagtggatacggaattcattaataagttcttagagttttcgaatagagtatacgaagctctctattacgttcactcgttgctttattctagtatgacttctgattcaaaaagtatcgaaaacaaacatcagagaagactagttaaactactgctgtga

SEQ ID NO: 252 - protein, 287 aa, vaccinia virus
MDEIVKNIREGTHVLLPFYETLPELNLSLGKSPLPSLEYGANYFLQISRVNDLNRMPTDMLKLFTHDIMLPESDLDKVYEILKINSVKYYGRSTKADAVVADLSARNKLFKRERDAIKSNNHLTENNLYISDYKMLTFDVFRPLFDFVNEKYCIIKLPTLFGRGVIDTMRIYCSLFKNVRLLKCVSDSWLKDSAIMVASDVCKKNLDLFMSHVKSVTKSSSWKDVNSVQFSILNNPVDTEFINKFLEFSNRVYEALYYVHSLLYSSMTSDSKSIENKHQRRLVKLLL

SEQ ID NO: 253 - DNA, 1656 bp, vaccinia virus
  CDS (1)...(1656)
atgaataatactatcattaattctttgatcggtggggatgactctattaaacggtctaatgtcttcgcagtcgatagtcaaattccaactttatatatgccgcaatatatttctctatccggagttatgacaaacgatggtccagacaatcaggctatcgctagcttcgaaattagggatcagtatattactgcgcttaatcatttggttctgagtttggaacttccagaagttaaaggtatgggaagattcggttacgtaccatatgttggatataaatgtattaattacgtatcggtctcttcgtgtaacggtgttatttgggaaattgagggcgaagaattatataataattgtatcaataatacaattgctttgaaacactctggatattctagtgaacttaatgatatttctattggcctaactcctaatgacactattaaagaaccatctacagtatacgtttatattaaaactccgtttgatgtggaagatacattcagcagtcttaaactatccgattcaaaaattaccgtaacggtaaccttcaatccagtatccgatatcgttattcgtgactcttcgttcgactttgaaacgttcaacaaagaatttgtttatgttcctgaattgagctttattggatatatggttaagaatgtacaaattaaaccatcgtttatagagaaacctaggagagtaataggtcaaataaaccaaccaacggcgactgtaactgaagttcatgcggcaacatcgctctctgtttatactaaaccttattatggaaatacggataataaatttatttcgtatccagggtactcacaagatgaaaaagattatatagatgcatatgtgagtagattgttggatgatctagttattgttagtgatggcccaccgactggttatccggagtctgccgagattgttgaggttccagaagatggtatcgtttctattcaagatgctgatgtgtatgtaaaaattgataatgttcctgataatatgagtgtttatcttcatactaatctgctaatgtttggaacacgaaaaaattcttttatatataacatttctaaaaagttttccgccattactggaacatatagtgatgccactaagagaacaatctttgctcacatatcacatagtatcaacatcatcgatacatctattcctgtaagtctttggactagtcaacgtaacgtctataacggagataatagatcagccgaatcaaaggccaaggatttgttcattaacgatcccttcatcaagggaatagattttaagaataagaccgatattatttctagactagaagttagatttggaaatgatgttctatattcagagaacggacccatctcgagaatttataatgaactactgacaaaaagcaataatggaacaagaaccctaacttttaactttacaccaaagatattctttaggccgacaactattacggctaatgtatctagggggaaagataaactatctgttcgagtagtttattccaccatggatgtcaaccatccaatctattatgtacaaaaacaattggtagttgtatgtaatgacctgtataaggtatcttacgatcaaggggtaagtattaccaagattatgggagataataactaa

SEQ ID NO: 254 - protein, 551 aa, vaccinia virus
MNNTIINSLIGGDDSIKRSNVFAVDSQIPTLYMPQYISLSGVMTNDGPDNQAIASFEIRDQYITALNHLVLSLELPEVKGMGRFGYVPYVGYKCINYVSVSSCNGVIWEIEGEELYNNCINNTIALKHSGYSSELNDISIGLTPNDTIKEPSTVYVYIKTPFDVEDTFSSLKLSDSKITVTVTFNPVSDIVIRDSSFDFETFNKEFVYVPELSFIGYMVKNVQIKPSFIEKPRRVIGQINQPTATVTEVHAATSLSVYTKPYYGNTDNKFISYPGYSQDEKDYIDAYVSRLLDDLVIVSDGPPTGYPESAEIVEVPEDGIVSIQDADVYVKIDNVPDNMSVYLHTNLLMFGTRKNSFIYNISKKFSAITGTYSDATKRTIFAHISHSINIIDTSIPVSLWTSQRNVYNGDNRSAESKAKDLFINDPFIKGIDFKNKTDIISRLEVRFGNDVLYSENGPISRIYNELLTKSNNGTRTLTFNFTPKIFFRPTTITANVSRGKDKLSVRVVYSTMDVNHPIYYVQKQLVVVCNDLYKVSYDQGVSITKIMGDNN

SEQ ID NO: 255 - DNA, 450 bp, vaccinia virus
  CDS (1)...(450)
atggctaagcgagtaagccttccagatgtggttatttcagcacctaaagcagtctttaagcccgctaaagaagaagcactcgcttgtatactaccaaagtattataaatctatggcagatgtgtctattaagacaaatagtgtaattgataagtgttggttttgtaatcaagatttggtttttaaacctattagtattgagacattcaagggtggtgaagttgggtatttctgttctaaaatatgtagggattcgttggcgtctatggttaagtctcacgtagctcttagagaagaaccaaaaatttctttgttgcctttagtattctatgaagataaggaaaaggttataaatacaataaacttactaagagataaagacggcgtttacggaagctgttactttaaggaaaactcacaaattatagatatttctctacggagtttattg

SEQ ID NO: 256 - protein, 150 aa, vaccinia virus
MAKRVSLPDVVISAPKAVFKPAKEEALACILPKYYKSMADVSIKTNSVIDKCWFCNQDLVFKPISIETFKGGEVGYFCSKICRDSLASMVKSHVALREEPKISLLPLVFYEDKEKVINTINLLRDKDGVYGSCYFKENSQIIDISLRSLL

SEQ ID NO: 257 - DNA, 675 bp, vaccinia virus
  CDS (1)...(675)
atgaatctacgattatgtagcggttgtagacacaacggtatagtatctgaacaaggatatgaatattgtattttttgcgagtcggtatttcaaaaatgtacaaaggtacaaaaaaagtcaaacttccacgtgtctaataaacttattcatttgagaaatgtattgcggagattattgtctcatcaatgttctggagaaattatctcggaactcttggatatcatggaaaaaaatcaaatatccacggatgatgtagatgcaaattttgtatctagttttcttaaggctaacgagagaataaataaaaaggattataagttagtctttgaaataatcaatcaagtaaaagatgagaaactgaatctgagtacagaaaagattaatgaagtagtagaaatatttaagcacttggtattcttttgccaagaaaacactccttctaagacaattaattattcattctttttggataaaatattcgatatcacttctgtaactaaaaatctaaaacctcaaactgttaaaaattatacgaaaaataatagtaaccaattagtatgggaaaactttttagcacatatgagatctaaaaaacgtgtaactatggtagaggattatggacacgagtatgtttttgtagatgagaggttttctacttgctcattagaagtataa

SEQ ID NO: 258 - protein, 224 aa, vaccinia virus
MNLRLCSGCRHNGIVSEQGYEYCIFCESVFQKCTKVQKKSNFHVSNKLIHLRNVLRRLLSHQCSGEIISELLDIMEKNQISTDDVDANFVSSFLKANERINKKDYKLVFEIINQVKDEKLNLSTEKINEVVEIFKHLVFFCQENTPSKTINYSFFLDKIFDITSVTKNLKPQTVKNYTKNNSNQLVWENFLAHMRSKKRVTMVEDYGHEYVFVDERFSTCSLEV

SEQ ID NO: 259 - DNA, 228 bp, vaccinia virus
  CDS (1)...(228)
atgagttggtacgaaaaatataacattgtactgaatccgcctaagcggtgttcttctgcatgtgcggataatttaactactatattggcggaggacggtaaccatattagggcgatactttattcacagcccaaaaaactaaaaatattacaggattttctggcaacgtctagaaataaaatgtttttatataaaatattggacgacgagatacgtagagtgttaaca

SEQ ID NO: 260 - protein, 76 aa, vaccinia virus
MSWYEKYNIVLNPPKRCSSACADNLTTILAEDGNHIRAILYSQPKKLKILQDFLATSRNKMFLYKILDDEIRRVLT

SEQ ID NO: 261 - DNA, 1935 bp, vaccinia virus
  CDS (1)...(1935)
atggaagccgtggtcaatagcgatgtttttttaacatctaacgcaggactaaaatctagttatactaatcaaactctttctttggtagatgaagatcatattcacacttctgataaatctttgtcttgtagtgtatgcaattcattatccaaaattgtagacgatgactttatatccgcaggggctagaaatcaacgtaccaaacctaaacgtgcaggaaataatcaatctcaacagcctatcaaaaaggattgtatggtttccatcgacgaagtagcatccacgcatgattggagtacgagattgagaaatgatgggaatgcaattgctaaatatctaactactaacaagtatgacacatctaactttactattcaggatatgcttaacattatgaataaactaaatattgtcagaacaaatagaaacgagctatttcaactccttacccatgtaaagagcacattgaacaatgctagtgtttctgtgaaatgtactcatcctttagtacttattcattctcgagctagtcctagaatcggtgaccaactcaaagagttagataaaatatactctccatctaatcatcatattcttctgtcgactacacgattccaatccatgcattttaccgatatgtctagttcacaagatttgtcttttatttatagaaaaccagaaactaattactatattcatcctattctgatggcactattcggtattaaacttcctgcgctcgagaacgcgtatgtacatggagacacctatagcctaatccagcaactttatgaatttagaaaagtaaagtcttataattatatgttgttggttaatcgtcttacggaggataatccgatagtgattacaggtgtatcagatctaatttccacagagattcagagagcaaacatgcataccatgattagaaaagcaattatgaacattagaatgggaattttttattgtaacgatgatgatgcggtagatccccatctaatgaagattattcatactggatgctctcaagttatgacagatgaggaacagatattggcttctattttgtctatagttggatttagacctacgttggtttctgtggctagacctataaacggcatcagttacgatatgaaacttcaggcggcaccatacatagttgttaatcctatgaagatgatcacaacatccgacagtccgatttctatcaattccaaggatatttattctatggcattcgatggcaatagtggaagagtggtgttcgctcctcctaacataggctatggaagatgttctggagttacacacattgatccattgggaactaatgtgatgggtagtgctgttcattcccctgttatcgttaatggagcaatgatgttttatgtagaacgacgtcagaataagaatatgtttggtggagaatgttacaccggctttagatctctaatagatgatactccgattgacgtatcaccagaaatcatgctaaacggtatcatgtataggttaaagtccgcagtttgttacaaactcggagaccaattctttgattgtggatcgtctgatatcttcttgaagggacattatacgattctatttacagaaaatggaccctggatgtacgatcctctttctgttttcaatccgggagctagaaatgctagattgatgcgagctctcaaaaaccagtacaagaaattatcaatggattcagacgatggtttttatgaatggttgaatggcgacggttcagtatttgctgcctcaaaacagcaaatgttgatgaatcacgttgctaactttgacgacgatcttctaactatggaagaagccatgtcgatgatttcgagacattgttgtatcttaatttatgcacaggattatgatcaatatattagcgctagacatattacagaactattttag

SEQ ID NO: 262 - protein, 644 aa, vaccinia virus
MEAVVNSDVFLTSNAGLKSSYTNQTLSLVDEDHIHTSDKSLSCSVCNSLSKIVDDDFISAGARNQRTKPKRAGNNQSQQPIKKDCMVSIDEVASTHDWSTRLRNDGNAIAKYLTTNKYDTSNFTIQDMLNIMNKLNIVRTNRNELFQLLTHVKSTLNNASVSVKCTHPLVLIHSRASPRIGDQLKELDKIYSPSNHHILLSTTRFQSMHFTDMSSSQDLSFIYRKPETNYYIHPILMALFGIKLPALENAYVHGDTYSLIQQLYEFRKVKSYNYMLLVNRLTEDNPIVITGVSDLISTEIQRANMHTMIRKAIMNIRMGIFYCNDDDAVDPHLMKIIHTGCSQVMTDEEQILASILSIVGFRPTLVSVARPINGISYDMKLQAAPYIVVNPMKMITTSDSPISINSKDIYSMAFDGNSGRVVFAPPNIGYGRCSGVTHIDPLGTNVMGSAVHSPVIVNGAMMFYVERRQNKNMFGGECYTGFRSLIDDTPIDVSPEIMLNGIMYRLKSAVCYKLGDQFFDCGSSDIFLKGHYTILFTENGPWMYDPLSVFNPGARNARLMRALKNQYKKLSMDSDDGFYEWLNGDGSVFAASKQQMLMNHVANFDDDLLTMEEAMSMISRHCCILIYAQDYDQYISARHITELF

SEQ ID NO: 263 - DNA, 846 bp, vaccinia virus
  CDS (1)...(846)
atggacttctttaacaagttctcacaggggctggcagaatcctctacaccaaagtcgtcaatctattattctgaagaaaaggatccggatacgaaaaaggatgaagcgattgaaataggactaaagtctcaagagtcgtattatcaaagacagttgcgagaacaactagctagagataatatgatggccgccagcagacagcctatccaaccgctacaaccaactattcatataactccacagccggttccggttccgacacctacatcggctcctattcttctacctagtagtactgctcctacaccaaaaccacgacaacaaactaatacatcatctgatatgtctaatctttttgattggctgtctgcagatactgatgcgccggcgagttcactccttccagcgttgacgccgagcaatgctgttcaggatattatctctaaatttaataaagatcaaaagacgacgacaccgccatctacccaaccttctcagacgttaccaacaactacatgtacacaacaatcggatggaaatatttcttgtactactccaacggttacacctcctcaacctcctattgtggccactgtatgtactcctacacctactggtggtacagtatgtacaacagcacaacaaaatccaggagcaacatctcaacaaaatctagacgatatggcccttaaggatctcatgtcgaatgttgaaagagatatgcaccaacttcaggccgaaacaaacgatctggtgacgaacgtatatgatgcaagggagtatacgcgtagggcaatagatcaaattctacaattagtcaaaggttttgaacgattccaaaagtaa

SEQ ID NO: 264 - protein, 281 aa, vaccinia virus
MDFFNKFSQGLAESSTPKSSIYYSEEKDPDTKKDEAIEIGLKSQESYYQRQLREQLARDNMMAASRQPIQPLQPTIHITPQPVPVPTPTSAPILLPSSTAPTPKPRQQTNTSSDMSNLFDWLSADTDAPASSLLPALTPSNAVQDIISKFNKDQKTTTPPSTQPSQTLPTTTCTQQSDGNISCTTPTVTPPQPPIVATVCTPTPTGGTVCTTAQQNPGATSQQNLDDMALKDLMSNVERDMHQLQAETNDLVTNVYDAREYTRRAIDQILQLVKGFERFQK

SEQ ID NO: 265 - DNA, 495 bp, vaccinia virus
  CDS (1)...(495)
atggcagacacagacgatattatcgactatgaatccgatgatctcactgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattag

SEQ ID NO: 266 - protein, 164 aa, vaccinia virus
MADTDDIIDYESDDLTEYEDDEEEEEDGESLETSDIDPKSSYKIVESASTHIEDAHSNLKHIGNHISALKRRYTRRISLFEIAGIIAESYNLLQRGRLPLVSEFSDETMKQNMLHVIIQEIEEGSCPIVIEKNGELLSVNDFDKDGLKFHLDYIIKIWKLQKRY

SEQ ID NO: 267 - DNA, 1119 bp, vaccinia virus
  CDS (1)...(1119)
atggacaaacttagagttctatacgatgagttcgtcaccattagtaaagataatcttgaacgcgagactggtcttagcgcatcagatgttgatatggattttgatttaaacatttttatgacgttggttccagtcttggagaaaaaggtatgcgctattacaccaactatagaagatgataaaatcgtaactatgatgaaatattgtagttatcagagtttttcattctggttccttaaatctggtgccgttgtgaaatcggtatataataaactagatgatgtgaaaaaggaaaagtttgtagccacatttagagacatgttgctcaatgtacaaactctaatttctcttaactctatgtatactagattgcgtcaagataccgaagatattgtatccgattccaaaaaaataatggagatcgtttcccatttgagagcgtcgactacagagaacgcggcgtatcaagttctccaacaaaacaatagttttatcatatctacactaaataaaatcttatctgatgaaaactatctcttgaaaattattgcagtattcgactctaaactaatttctgaaaaggagacattgaatgaatacaaacaattgtacaccatttcttctgaaagtttggtatacggaatcagatgcgttagtaatctggatatatcatctgttcaactgagtaacaataaatacgttctctttgttaagaaaatgctacctaaaatcatactgtttcagaataacgacatcaatgcacaacaattcgctaatgttatttctaaaatttatacgttgatttatagacaattgacgtcgaatgtcgatgttggatgtctattgacagatacgatagaatctgccaaaactaaaatatctgtagaaaaaattaaacagacgggtatcaataatgttcaaagtcttatcaaattcatatctgataacaagaaagaatataagacaataatctctgaagaatatctatcgaaggaagatagaatcattactattttgcaagatatcgttaatgaacacgatataaagtacgacaataaattgctgaacatgcgagacttgattgtgacatttagagaacgatattcgtataaattctaa

SEQ ID NO: 268 - protein, 372 aa, vaccinia virus
MDKLRVLYDEFVTISKDNLERETGLSASDVDMDFDLNIFMTLVPVLEKKVCAITPTIEDDKIVTMMKYCSYQSFSFWFLKSGAVVKSVYNKLDDVKKEKFVATFRDMLLNVQTLISLNSMYTRLRQDTEDIVSDSKKIMEIVSHLRASTTENAAYQVLQQNNSFIISTLNKILSDENYLLKIIAVFDSKLISEKETLNEYKQLYTISSESLVYGIRCVSNLDISSVQLSNNKYVLFVKKMLPKIILFQNNDINAQQFANVISKIYTLIYRQLTSNVDVGCLLTDTIESAKTKISVEKIKQTGINNVQSLIKFISDNKKEYKTIISEEYLSKEDRIITILQDIVNEHDIKYDNKLLNMRDLIVTFRERYSYKF

SEQ ID NO: 269 - DNA, 2133 bp, vaccinia virus
  CDS (1)...(2133)
atgcgatatatagtaagtccgcaattggtattacaggtgggtaaggggcaggaggtagaacgagccctatatctcactccatatgattacatagatgagaagtcgcccatatattattttttacgaagtcatttaaatatacaacagccggaaatagttaagagacatattctattgacgcttcgaatgactcaattaaagggatatttaggaaatttgttagatattaaggacgatattattatctattctcataagaataatttggaatatagttacgttgataatactatttttaatcccttcgtatatactcagaaaaaaacactactaaaaaacgatagctttttatacaatgtatatcctggagcgtgtgactttttggttatctgggtggctagagcgtgcgatacatctattccggaatttggatcgtacgaagatgtagataataatattatcaagtttgaaacaatgttgatggaagtatttccacaactagatttggacattactgtagaatcaaagtttaacaatatatttcgtaccaatctaaaactaactgggttaaaaaagatcattcagcgagttcaagacttggacattaattataagtcgttgttatctagatacgatgaacactttattaatatgaccggtaatcattttattctaaacgatgaacagttaaatctctccatttgggacttggatggtacattagcgttatctagcgacggcgataccgtgatgattaataacgtaaaactatttacagatcttgtgtccgatatagatacacaaatggaacgcatcaagggagatataacgtataaggtacatttggcgactcctatcaattctagaataaaattggatatcgagactagcttcatttttatagagacggcgactaataatattttactatcctcggataaaaaaatatctatcattttggccaaaaaccatatatctattaaagtgaaaaaccatattcctaacatagaaaaatattttacatttttagttattgccattaatgccatgtttaatagcgttcaaaagtctgctgattttaccaaagtggaaactgtttactggtctaggatatgccaaaatacaaagaataagaatagaaaacccatcattattaattatctagatcctggaatgaaaaaaatcagtaacaacttttacagatccgatgagaaagaagtctttattaatgataacggcataatgtttacgtgcatggatcctttggggaaatataataaggtgggatttcttaatatatttcatgatatgcggaaatattgtatcccttgttgttttctacatgatcaatctcatcgaagtacattttcatcgtgtgttcatcaaattgacgttgaaaaaaagatagtaagtccgtatatccttaattttggtaaagttgtaacagaatccaaaatgtcatttctccctattatctttgacgccttcttaaatgatggaatgactgctaatatggaacaagataataaacgactaaaggaaactagtggatatcatatagttagatgttgtgctggtgatgatatagttcgtttacgaactacatctgatattattcagtttgtaaacgaggataaaaatattcttatagttaacgacatggtatattttccaatgaacgcgtccgatataggaaagaaaatacatatactcattcaagaaatagttcatgaggtaatgatagtaaaaaagaaagagtctagtgataaaatcgattttttcccacccaactataagttattgaaggatctatttccaaaacaaactattcaaactcctattcaatctgacgcgggaatggtgttaacaaccgatggattctacatagatggaaaactttttaacgaagatctgtcgtctaaatacgttacatttacaaaaaatgttattgcgtctgatgccgtagctaaatatttttctcctttgtttaaatacgttatttcagaagctaaagatagatttatcaaaacgtggatgattaatattatgatacatatgaacgtagatcctaataatataataccgacgttagaaaaatactatcccaactctggaagagcacaaataaattaa

SEQ ID NO: 270 - protein, 710 aa, vaccinia virus
MRYIVSPQLVLQVGKGQEVERALYLTPYDYIDEKSPIYYFLRSHLNIQQPEIVKRHILLTLRMTQLKGYLGNLLDIKDDIIIYSHKNNLEYSYVDNTIFNPFVYTQKKTLLKNDSFLYNVYPGACDFLVIWVARACDTSIPEFGSYEDVDNNIIKFETMLMEVFPQLDLDITVESKFNNIFRTNLKLTGLKKIIQRVQDLDINYKSLLSRYDEHFINMTGNHFILNDEQLNLSIWDLDGTLALSSDGDTVMINNVKLFTDLVSDIDTQMERIKGDITYKVHLATPINSRIKLDIETSFIFIETATNNILLSSDKKISIILAKNHISIKVKNHIPNIEKYFTFLVIAINAMFNSVQKSADFTKVETVYWSRICQNTKNKNRKPIIINYLDPGMKKISNNFYRSDEKEVFINDNGIMFTCMDPLGKYNKVGFLNIFHDMRKYCIPCCFLHDQSHRSTFSSCVHQIDVEKKIVSPYILNFGKVVTESKMSFLPIIFDAFLNDGMTANMEQDNKRLKETSGYHIVRCCAGDDIVRLRTTSDIIQFVNEDKNILIVNDMVYFPMNASDIGKKIHILIQEIVHEVMIVKKKESSDKIDFFPPNYKLLKDLFPKQTIQTPIQSDAGMVLTTDGFYIDGKLFNEDLSSKYVTFTKNVIASDAVAKYFSPLFKYVISEAKDRFIKTWMINIMIHMNVDPNNIIPTLEKYYPNSGRAQIN

SEQ ID NO: 271 - DNA, 867 bp, vaccinia virus
  CDS (1)...(867)
atgttcgaaccagtaccagatcttaatttggaggcctccgtagaactaggggaggtaaatatagatcaaacaacacctatgataaaggaaaatagcggttttatatcccgtagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcagaacttccaataaaattacttaaagatagaaatgaattatttacaaaattcatcaacgagttaaaaaagaccagttcattcaagataagcaaacgcgataaggatacgctactaaaatattttacttag

SEQ ID NO: 272 - protein, 288 aa, vaccinia virus
MFEPVPDLNLEASVELGEVNIDQTTPMIKENSGFISRSRRLFAHRSKDDERKLALRFFLQRLYFLDHREIHYLFRCVDAVKDVTITKKNNIIVAPYIALLTIASKGCKLTETMIEAFFPELYNEHSKKFKFNSQVSIIQEKLGYQFGNYHVYDFEPYYSTVALAIRDEHSSGIFNIRQESYLVSSLSEITYRFYLINLKSDLVQWSASTGAVINQMVNTVLITVYEKLQLVIENDSQFTCSLAVESELPIKLLKDRNELFTKFINELKKTSSFKISKRDKDTLLKYFT

SEQ ID NO: 273 - DNA, 327 bp, vaccinia virus
  CDS (1)...(327)
atgtcatgttatacagctatattaaaatctgtaggaggactggcgctatttcaagtagccaatggcgccatagatttatgtagacatttctttatgtatttttgtgaacaaaagctacgaccaaattcattttggttcgtcgttgttagagccattgcgagcatgataatgtatttagtattaggtatagcattgctgtatatttctgaacaagatgacaagaagaatactaataatgccaacactaataatgatagtaatagtaataatagtaacaatgataaacgaaatgagtcgtctataaattctaactccagtcctaagtaa

SEQ ID NO: 274 - protein, 108 aa, vaccinia virus
MSCYTAILKSVGGLALFQVANGAIDLCRHFFMYFCEQKLRPNSFWFVVVRAIASMIMYLVLGIALLYISEQDDKKNTNNANTNNDSNSNNSNNDKRNESSINSNSSPK

SEQ ID NO: 275 - DNA, 2673 bp, vaccinia virus
  CDS (1)...(2673)
atgatgcctattaagtcaatagttactcttgatcaattagaggactctgaatatttatttcgtatagtttctaccgttcttccgcatctatgtctagattacaaagtatgtgaccaacttaaaacaaccttcgttcatccgttcgatatattgcttaataactcattaggatccgtaactaaacaagatgagcttcaggctgctatatccaaattgggcattaattatttaattgataccacgtcacgtgaattaaaactgtttaatgttacacttaacgctggaaatatagatattattaataccccaattaacattagttcggaaactaaccctattattaatactcacagcttttacgatcttccacctttcactcaacaccttcttaatattagattgacggatacagaatacagagctagatttatcggtggttatattaaaccagatggctccgactcaatggatgttctagcagaaaagaaatacccagatcttaactttgataatacttatttgtttaacatcctctataaggatgttattaatgcaccaataaaagaattcaaggcaaaaattgttaacggtgtattaagcagacaagattttgataatcttataggtgttagacaatatataacagcacaagatcgaccccgctttgacgacgcttataacatcgcagatgctgctagacattatggagttaatcttaatacattgccattaccaaacgtcgatctcactactatgccaacatataaacatctcatcatgtttgaacagtacttcatttatacatatgacagagtggatatttattacaatggtaacaaaatgctcttcgatgatgagattatgaacttttgtatttctatgcgatatcaatctcttattcctagactggtagaattctttccagatataccagtaaacaataacatcgtacttcatactcgaaatcctcaaaatgctgcagtgaacgtaacagttacgcttccaaacgtgcaatttgtagacataggtagaaaccacaaattctttattaatttctttaacctgttggcgaaggaacaaagatctacggctatcaaagttaccaaatccatgttttgggacggtatggattacgaggaatacaagtctaaaaaccttcaggacatgatgtttataaattctacctgttatgtattcggtctttataatcacaataatactacttattgctctatcctttctgatattatctccgcagagaaaacacctattagagtttgtttgttacctagagtagtcggaggtaagactgttactaatcttatttcagaaactttgaagagtatttcatctatgactatacgagagtttcccaggaaagataaatctatcatgcatataggactttctgagacgggattcatgagattcttccaactactcaggctcatggctgataaacctcatgaaacggctattaaagaggttgttatggcttatgtgggtataaagttgggtgacaaaggtagtccgtactatattagaaaggagtcataccaagactttatctatctgctatttgcatcaatgggctttaaggtgactactagaagatccattatgggaagtaataatatctctatcatcagtattagaccaagagtaactaaacaatacatcgtcactacattgatgaaaactagttgtagtaaaaacgaggcagaaaaattaattacttcagcgtttgatcttctcaatttcatggtatcagttagtgactttagagattatcagagttacagacagtatagaaactattgtcctagatatttctatgcaggatctcccgaaggagaggaaaccattatctgtgactcggaaccgataagtatcttggatagaattgatactcgtggtatcttttctgcgtatactattaatgaaatgatggacactgatatcttttctccagagaataaggcatttaagaataatctgagtagatttatcgagagtggagatattacaggagaagatattttctgcgcaatgccatacaacatcttagataggattattacaaatgctggtacgtgtaccgtatccataggtgatatgttggataacattacaacccagtcagactgtaatatgactaacgaaatcacagatatgataaacgcctcattgaagaatacaatttctaaagataataatatgctagtcagccaagcattggactctgtagctaatcgttctaaacaaacgattggagacttgagacaatcatcgtgtaaaatggcattgttgtttaaaaatcttgttacatccatctacacaatagaacgtattttcaatgctaaagtaggcgatgatgttaaggcatcgatgttggagaagtataaagtattcacagatatttccatgtcattgtataaagacttgatagctatggagaatctcaaagcgatgctatacattattcgacgaagcggatgcagaatagacgatgcacaaattactactgacgatctagtcaagtcttactcattgatccgtcctaaaattctaagtatgataaactattataatgaaatgagtagaggatactttgaacacatgaaaaaaaatctaaatatgacagatggtgactctgtctcttttgatgatgaa

SEQ ID NO: 276 - protein, 891 aa, vaccinia virus
MMPIKSIVTLDQLEDSEYLFRIVSTVLPHLCLDYKVCDQLKTTFVHPFDILLNNSLGSVTKQDELQAAISKLGINYLIDTTSRELKLFNVTLNAGNIDIINTPINISSETNPIINTHSFYDLPPFTQHLLNIRLTDTEYRARFIGGYIKPDGSDSMDVLAEKKYPDLNFDNTYLFNILYKDVINAPIKEFKAKIVNGVLSRQDFDNLIGVRQYITAQDRPRFDDAYNIADAARHYGVNLNTLPLPNVDLTTMPTYKHLIMFEQYFIYTYDRVDIYYNGNKMLFDDEIMNFCISMRYQSLIPRLVEFFPDIPVNNNIVLHTRNPQNAAVNVTVTLPNVQFVDIGRNHKFFINFFNLLAKEQRSTAIKVTKSMFWDGMDYEEYKSKNLQDMMFINSTCYVFGLYNHNNTTYCSILSDIISAEKTPIRVCLLPRVVGGKTVTNLISETLKSISSMTIREFPRKDKSIMHIGLSETGFMRFFQLLRLMADKPHETAIKEVVMAYVGIKLGDKGSPYYIRKESYQDFIYLLFASMGFKVTTRRSIMGSNNISIISIRPRVTKQYIVTTLMKTSCSKNEAEKLITSAFDLLNFMVSVSDFRDYQSYRQYRNYCPRYFYAGSPEGEETIICDSEPISILDRIDTRGIFSAYTINEMMDTDIFSPENKAFKNNLSRFIESGDITGEDIFCAMPYNILDRIITNAGTCTVSIGDMLDNITTQSDCNMTNEITDMINASLKNTISKDNNMLVSQALDSVANRSKQTIGDLRQSSCKMALLFKNLVTSIYTIERIFNAKVGDDVKASMLEKYKVFTDISMSLYKDLIAMENLKAMLYIIRRSGCRIDDAQITTDDLVKSYSLIRPKILSMINYYNEMSRGYFEHMKKNLNMTDGDSVSFDDE

SEQ ID NO: 277 - DNA, 957 bp, vaccinia virus
  CDS (1)...(957)
atgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacgtttcgtagagagttattgatatcggaacaacgtcaacaacgagaaaaaagatttaatattacagtatcgaaaaatgctgaagcaataatggaatctagatctatgataacttctatgccaacacaaacaccatccttgggagtagtttatgataaagataaaagaattcagatgttagaggatgaagtggttaatcttagaaatcaacgatctaatacaaaatcatctgataatttagataattttaccaaaatactatttggtaagactccgtacaaatcaacagaagttaataagcgtatagccatcgttaattatgcaaatttgaacgggtctcccttatcagtcgaggacttggatgtttgttcagaggatgaaatagatagaatctataaaacgattaaacaatatcacgaaagtagaaaacgaaaaattatcgtcactaacgtgattattattgtcataaacattatcgagcaggcattgctaaaactcggatttgaagaaatcaaaggactgagtaccgatatcacttcagaaattatcgatgtggagatcggagatgactgcgatgctgtagcatctaaactaggaatcggtaacagtccggttcttaatattgtattgtttatactcaagatattcgttaaacgaattaaaattatttaa

SEQ ID NO: 278 - protein, 318 aa, vaccinia virus
MTTVPVTDIQNDLITEFSEDNYPSNKNYEITLRQMSILTHVNNVVDREHNAAVVSSPEEISSQLNEDLFPDDDSPATIIERVQPHTTIIDDTPPPTFRRELLISEQRQQREKRFNITVSKNAEAIMESRSMITSMPTQTPSLGVVYDKDKRIQMLEDEVVNLRNQRSNTKSSDNLDNFTKILFGKTPYKSTEVNKRIAIVNYANLNGSPLSVEDLDVCSEDEIDRIYKTIKQYHESRKRKIIVTNVIIIVINIIEQALLKLGFEEIKGLSTDITSEIIDVEIGDDCDAVASKLGIGNSPVLNIVLFILKIFVKRIKII

SEQ ID NO: 279 - DNA, 579 bp, vaccinia virus
  CDS (1)...(579)
atggcggataaaaaaaatttagccgttagaagcagttacgatgattatatcgaaacagttaataagattacaccacagcttaaaaatctactagcgcaaatcggtggagatgcagccgtcaaaggaggcaacaataatcttaattctcaaacagatgtgactgccggcgcatgtgatacaaaatcaaagagttcaaaatgtattacatgtaaaccaaaatcaaaatcctcgtcttcttctacatcaacatccaagggctccaaaaatacttctggtgctcctaaacgtagaacaacagttactactacatcgtacaatgcgatggatggtcagattgtccaagctgttactaatgctggtaaaatagtttatggtaccgtcagagacggccaattagaagttcgtggaatggtcggagagatcaatcacgatcttctaggtatcgaatcagttaatgctgggaaaaagaaaccatctaaaaagatgcccactaataaaaagattaatatgtcgtccggtatgagacgacaggaacagattaatccagacgattgttgtctggatatgggaatgtattaa

SEQ ID NO: 280 - protein, 192 aa, vaccinia virus
MADKKNLAVRSSYDDYIETVNKITPQLKNLLAQIGGDAAVKGGNNNLNSQTDVTAGACDTKSKSSKCITCKPKSKSSSSSTSTSKGSKNTSGAPKRRTTVTTTSYNAMDGQIVQAVTNAGKIVYGTVRDGQLEVRGMVGEINHDLLGIESVNAGKKKPSKKMPTNKKINMSSGMRRQEQINPDDCCLDMGMY

SEQ ID NO: 281 - DNA, 210 bp, vaccinia virus
  CDS (1)...(210)
atgattggtattcttttgttgatcggtatttgcgtagcagttaccgtcgccatcctatatgcgctgtataataagatcaagaacccacaaaatccgaatccaagtccgaatttaaattcgcctcctccagaaccaagaaataccaagtttgtaaataatctggaaaaggatcatattagttcattgtataatctagttaaatcttctgca

SEQ ID NO: 282 - protein, 70 aa, vaccinia virus
MIGILLLIGICVAVTVAILYALYNKIKNPQNPNPSPNLNSPPPEPRNTKFVNNLEKDHISSLYNLVKSSA

SEQ ID NO: 283 - DNA, 273 bp, vaccinia virus
  CDS (1)...(273)
atggacatgatgcttatgattggaaattatttttccggcgtgctaatcgctggaatcattcttttgattctttcgtgtatcttcgcctttattgactttagtaagtctaccagtcccactcgtacatggaaagtattgagtattatggcgtttatacttggtattattatcacagtcggaatgctaatttattctatgtggggaaagcactgcgcgccccacagagttagcggagtcattcacaccaatcatagcgatatttccgtgaactaa

SEQ ID NO: 284 - protein, 90 aa, vaccinia virus
MDMMLMIGNYFSGVLIAGIILLILSCIFAFIDFSKSTSPTRTWKVLSIMAFILGIIITVGMLIYSMWGKHCAPHRVSGVIHTNHSDISVN

SEQ ID NO: 285 - DNA, 162 bp, vaccinia virus
  CDS (1)...(162)
atgataagtaattacgagccgttgctgctgttagttataacatgctgtgtactactatttaattttaccatatcttcgaaaacaaaaatagatattatttttgcagtacaaactattgtttttatatggtttatattccactttgttcattcggcgatttaa

SEQ ID NO: 286 - protein, 53 aa, vaccinia virus
MISNYEPLLLLVITCCVLLFNFTISSKTKIDIIFAVQTIVFIWFIFHFVHSAI

SEQ ID NO: 287 - DNA, 285 bp, vaccinia virus
  CDS (1)...(285)
atgttcgtagacgataattcgttgataatttattctacatggcccagtacattgtccgattcatcaggtagagtcatcgttatgccagataatagatcattcacgtttaaggaagggtttaaattagatgaatcgataaaatctatattgttggtaaacccgtcgtctatagatctattaaagattagagtatataaacatcgcataaaatggatgggtgatatattcgtattatttgagcaagaaaatatcccaccaccttttcgtctagtaaatgataagtaa

SEQ ID NO: 288 - protein, 94 aa, vaccinia virus
MFVDDNSLIIYSTWPSTLSDSSGRVIVMPDNRSFTFKEGFKLDESIKSILLVNPSSIDLLKIRVYKHRIKWMGDIFVLFEQENIPPPFRLVNDK

SEQ ID NO: 289 - DNA, 1134 bp, vaccinia virus
  CDS (1)...(1134)
atgggggcagccgttactcttaatagaattaaaatagcaccaggaatagcagatatacgagacaaatatatggaattaggttttaattatcctgaatataatagagctgttaagtttgccgaagaaagttatatgtattattatgaaacgtctccaggagaaattaaacccaaattttgtttgatagatggtatgtcgatagatcattgtagtagttttatagttcctgaatttgctaaacaatatgtattaattcatggagaaccatgtagttctttcaaatttcgtcctggatcattaatctattatcagaacgaggtaactcctgaatatattaaggatttaaaacacgctactgattatatagcatccgggcaacgatgtcattttataaaaaaggattatctcctgggcgatagtgatagcgtggcaaaatgttgttctaagacaaataccaaacactgtccaaaaatatttaataataattacaagacagaacattgtgatgatttcatgactggattttgtagaaacgatcctggaaaccccaattgtttagaatggttacgtgcaaaacggaaaccggctatgtctacttattccgatatttgctccaaacatatggatgcgagatattgttctgagtttattagaattattcgtcctgattattttacttttggggatacggcattatacgtcttttgtaacgatcataaaggaaatagaaattgttggtgcgcgaattatccaaaatctaattccggagataaatatttaggacctagggtatgttggttacatgagtgcaccgacgaatctagagatagaaaatggttatattataatcaagatgttcaaagaactagatgtaaatacgttgggtgcacgattaacgttaactctttagcgttaaaaaattcccaagcggaacttacgtctaattgtactagaactacgtctgcagttggtaacgtacatcatccaggagaacctgtagtaaaagataaaataaaactgcctacctggttgggcgcggccataacactggttgtaatatctgttattttctattttatatccatttattcgcgtcctaaaattaaaacaaatgatataaatgttcgtagacga

SEQ ID NO: 290 - protein, 378 aa, vaccinia virus
MGAAVTLNRIKIAPGIADIRDKYMELGFNYPEYNRAVKFAEESYMYYYETSPGEIKPKFCLIDGMSIDHCSSFIVPEFAKQYVLIHGEPCSSFKFRPGSLIYYQNEVTPEYIKDLKHATDYIASGQRCHFIKKDYLLGDSDSVAKCCSKTNTKHCPKIFNNNYKTEHCDDFMTGFCRNDPGNPNCLEWLRAKRKPAMSTYSDICSKHMDARYCSEFIRIIRPDYFTFGDTALYVFCNDHKGNRNCWCANYPKSNSGDKYLGPRVCWLHECTDESRDRKWLYYNQDVQRTRCKYVGCTINVNSLALKNSQAELTSNCTRTTSAVGNVHHPGEPVVKDKIKLPTWLGAAITLVVISVIFYFISIYSRPKIKTNDINVRRR

SEQ ID NO: 291 - DNA, 612 bp, vaccinia virus
  CDS (1)...(612)
atgagttatttaagatattacaatatgcttgacgacttctctgcgggtgctggagtgcttgataaagatttatttacagaggaacagcagcaatcgtttatgcctaaagatggaggtatgatgcaaaacgattatggaggaatgaatgattatttgggaatcttcaaaaataatgatgttagaacgttactcggtttgattttgttcgtcttggctctatatagccctcctctaatctctatattgatgatatttatctcatcttttctattgcctcttactagcttagttattacctattgcttagtaactcaaatgtatcgtggaggtaatggcaacactgtgggaatgtctattgtatgtattgtagctgctgtaattattatggcaatcaatgtatttacgaattcacagatatttaatattatttcttacattattttgtttattctgttctttgcatatgtgatgaacatcgaaagacaggactatagaagaagtataaatgtaaccattcctgaacagtatacctgcaacaaaccttatactgcgggaaataaggtaaatgttgatataccaacatttaacagtttaaatactgacgattattaa

SEQ ID NO: 292 - protein, 203 aa, vaccinia virus
MSYLRYYNMLDDFSAGAGVLDKDLFTEEQQQSFMPKDGGMMQNDYGGMNDYLGIFKNNDVRTLLGLILFVLALYSPPLISILMIFISSFLLPLTSLVITYCLVTQMYRGGNGNTVGMSIVCIVAAVIIMAINVFTNSQIFNIISYIILFILFFAYVMNIERQDYRRSINVTIPEQYTCNKPYTAGNKVNVDIPTFNSLNTDDY

SEQ ID NO: 293 - DNA, 1482 bp, vaccinia virus
  CDS (1)...(1482)
atgtcactattaaagatggagtataatctttatgccgaactaaaaaaaatgacttgtggtcaacccctaagtctttttaacgaagacggggattttgtagaagttgaaccgggatcatcctttaagtttctgatacctaagggattttacgcctctccttccgtaaagacgagtctagtatttgaaacattaacaacgaccgataataaaatcactagtatcaatccaacaaatgcgccaaagttatatcctcttcaacgcaaagtcgtatctgaagtagtttctaatatgaggaaaatgatcgaatcaaaacgtcctctatacattactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaacagaatttattgtaacagtattattaatattgccaagttatccgatctaaaaaaaactatctatgcggtagatagtttttttgagccatattccacagacaatattagacatatggtaaaacgactagatggaccatctaataaatatcatatatataccgagaagttattatctgtagacgagcctagaaatcaacttattcttaataccctggtagaagaattcaagtcaggaactattaatcgcattttagttattactaaactacgtgaacatatggtattattctacaaacgattattagatcttttcggaccagaggttgtatttataggagacgcccaaaatagacgtactccagatatggtcaaatcaatcaaggaactaaatagatttatattcgtatccaccttattttattccggtactggtttagatattcctagtttggattctttgttcatttgctcggcagtaatcaacaatatgcaaatagagcaattactagggaggatatgtcgagaaacagaactattagataggacggtatatgtatttcctagcacatccatcaaagaaataaagtacatgataggaaatttcgttcaacgaattattagtctgtctgtagataaactaggatttaaacaaaaaagttatcggaaacatcaagaatccgatcccacttctgcatgtacaacatcatccagagaagaacgtgtattaaatagaatatttaactcgcaaaatcgttaa

SEQ ID NO: 294 - protein, 493 aa, vaccinia virus
MSLLKMEYNLYAELKKMTCGQPLSLFNEDGDFVEVEPGSSFKFLIPKGFYASPSVKTSLVFETLTTTDNKITSINPTNAPKLYPLQRKVVSEVVSNMRKMIESKRPLYITLHLACGFGKTITTCYLMATHGRKTVICVPNKMLIHQWKTQVEAVGLEHKISIDGVSSLLKELKTQSPDVLIVVSRHLTNDAFCKYINKHYDLFILDESHTYNLMNNTAVTRFLAYYPPMMCYFLTATPRPSNRIYCNSIINIAKLSDLKKTIYAVDSFFEPYSTDNIRHMVKRLDGPSNKYHIYTEKLLSVDEPRNQLILNTLVEEFKSGTINRILVITKLREHMVLFYKRLLDLFGPEVVFIGDAQNRRTPDMVKSIKELNRFIFVSTLFYSGTGLDIPSLDSLFICSAVINNMQIEQLLGRICRETELLDRTVYVFPSTSIKEIKYMIGNFVQRIISLSVDKLGFKQKSYRKHQESDPTSACTTSSREERVLNRIFNSQNR

SEQ ID NO: 295 - DNA, 231 bp, vaccinia virus
  CDS (1)...(231)
atggatagcaccaatgtgcgttccggaatgaagagtcgcaaaaagaagcccaagactacagttatcgatgacgatgatgattgcatgacgtgttctgcctgtcagtctaaattggttaagatttccgacatcacaaaagtatcattggattatattaatactatgaggggtaatacactggcctgcgcagcatgcggatcgtcgcttaaacttcttaacgattttgcgagt

SEQ ID NO: 296 - protein, 77 aa, vaccinia virus
MDSTNVRSGMKSRKKKPKTTVIDDDDDCMTCSACQSKLVKISDITKVSLDYINTMRGNTLACAACGSSLKLLNDFAS

SEQ ID NO: 297 - DNA, 351 bp, vaccinia virus
  CDS (1)...(351)
atgataactttatttttaatcctatgttatttcattcttatttttaatattatagtacctgcaatatctgaaaaaatgagacgcgaacgagccgcatacgtaaactacaaacgtctaaacaagaatttcatttgtgtcgatgatagactgtttagttataattttacaacatctggaattaaggcaaaggtggccgttgataacaaaaatgtttccattccatgttccaagataaacgaggtcaataataataaaaatgtcgatacactatattgtgataaagatagagacgatataccaggttttgcacgatcgtgctatagggcatattctgacttattttttactacc

SEQ ID NO: 298 - protein, 117 aa, vaccinia virus
MITLFLILCYFILIFNIIVPAISEKMRRERAAYVNYKRLNKNFICVDDRLFSYNFTTSGIKAKVAVDNKNVSIPCSKINEVNNNKNVDTLYCDKDRDDIPGFARSCYRAYSDLFFTT

SEQ ID NO: 299 - DNA, 1281 bp, vaccinia virus
  CDS (1)...(1281)
atgacttctagcgctgatttaactaacttaaaagaattacttagtctgtacaaaagtttgagattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagataatatgcgaagtgcgtgtaacaaagtattagatagtgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctcttttgatgataaatttccaaaaatatccatatcgtatattaagttgggagaacttaggcggcaagttgtagactttttcaaattctcattcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatggaaactttaaccagttcgtctcaatctttaatgtcgtcaccgatgtcaaaaaaagattattcgagtga

SEQ ID NO: 300 - protein, 426 aa, vaccinia virus
MTSSADLTNLKELLSLYKSLRFSDSAAIEKYNSLVEWGTSTYWKIGVQKVANVETSISDYYDEVKNKPFNIDPGYYIFLPVYFGSVFIYSKGKNMVELGSGNSFQIPDNMRSACNKVLDSDNGIDFLRFVLLNNRWIMEDAISKYQSPVNIFKLASEYGLNIPKYLEIEIEEDTLFDDELYSIIERSFDDKFPKISISYIKLGELRRQVVDFFKFSFMYIESIKVDRIGDNIFIPSVITKSGKKILVKDVDHLIRSKVREHTFVKVKKKNTFSILYDYDGNGTETRGEVIKRIIDTIGRDYYVNGKYFSKVGSAGLKQLTNKLDINECATVDELVDEINKSGTVKRKIKNQSAFDLSRECLGYPEADFITLVNNMRFKIENCKVVNFNIENTNCLNNPSIETIYGNFNQFVSIFNVVTDVKKRLFE

SEQ ID NO: 301 - DNA, 564 bp, vaccinia virus
  CDS (1)...(564)
atggaaactttaaccagttcgtctcaatctttaatgtcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaa

SEQ ID NO: 302 - protein, 187 aa, vaccinia virus
METLTSSSQSLMSSPMSKKDYSSEIICAFDIGAKNPARTVLEVKDNSVRVLDISKLDWSSDWERRIAKDLSQYEYTTVLLERQPRRSPYVKFIYFIKGFLYHTSAAKVICVSPVMSGNSYRDRKKRSVEAFLDWMDTFGLRDSVPDRRKLDDVADSFNLAMRYVLDKWNTNYTPYNRCKSRNYIKKM

SEQ ID NO: 303 - DNA, 1149 bp, vaccinia virus
  CDS (1)...(1149)
atggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcatgccattaagaaactagtgtattgcgacatccaacttactaaacacattattaatcagaatacgtatccggtatttaacgattcttcacaagtgaaatgttgtcattatttcgatataaactcagataatagcaatattagctctcgtacagtagagatatttgagagggaaaagtcatctcttgtatcatatattaaaactaccaataagaagagaaaggtcaattatggggaaataaagaaaactgtacatggaggcactaatgcaaattacttttccggtaaaaagtctgatgagtatctgagcactacagtcaggtccaacattaatcaaccttggatcaaaaccatttctaagagaatgagagtagatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaagatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatga

SEQ ID NO: 304 - protein, 382 aa, vaccinia virus
MDNLFTFLHEIEDRYARTIFNFHLISCDEIGDIYGLMKERISSEDMFDNIVYNKDIHHAIKKLVYCDIQLTKHIINQNTYPVFNDSSQVKCCHYFDINSDNSNISSRTVEIFEREKSSLVSYIKTTNKKRKVNYGEIKKTVHGGTNANYFSGKKSDEYLSTTVRSNINQPWIKTISKRMRVDIINHSIVTRGKSSILQTIEIIFTNRTCVKIFKDSTMHIILSKDKDEKGCIHMIDKLFYVYYNLFLLFEDIIQNEYFKEVANVVNHVLTATALDEKLFLIKKMAEHDVYGVSNFKIGMFNLTFIKSLDHTVFPSLLDEDSKIKFFKGKKLNIVALRSLEDCINYVTKSENMIEMMKERSTILNSIDIETESVDRLKELLLK

SEQ ID NO: 305 - DNA, 3495 bp, vaccinia virus
  CDS (1)...(3495)
atgaaaaaaaacactgattcagaaatggatcaacgactagggtataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgattaacgagttcaaatatgaaatgctgcataactttttacctcatatgaactatacacccgatcaactaaagggattttatatgatatctttactaagaaagtttctctactgtatctaccacacttctagatatccagatagagattcgatggtttgtcatcgtatactaacatacggcaaatattttgagacgttggcacatgatgaattagagaattacataggcaacatccgaaacgatatcatgaacaatcacaagaacagaggcacttacgcggtaaacattcatgtactaacaactcctggacttaatcatgcgttttctagcttattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcggacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgatatgacattctctgacattcagaaagagtttccacatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtagcatcttcactagtgggaatcaatcacaattctggacccagagctattcttggatgtgctcaagctaaacaagctatctcttgtctgagttcggatatacgaaataaaatagacaatggaattcatttgatgtatccagagaggccaattgtcattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatatagttaccgcaaagaaacatcaagtagaaattccgttggaaaactttaataacaaagaaagagataggtctaacgcctattcaaaattagaaagtaatggattagttagactgaatgctttcttggaatccggagacgctatggcacgaaatatctcatcaagaactcttgaagatgattttgctagagataatcagattagcttcgatgtttccgagaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatgtcgcggatgaaacggaacttccatacgacgaaaatggtatcacaccagatgtcattattaattctacatccatcttctctagaaaaactatatctatgttgatagaagttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtctgatgaagaattatcggataaaatcttttgtgaaaagattctctatgatcctgaaacggataagccttatgcatccaaagtattttttggaccaatttattacttgcgtctgagacatttaactcaggacaaggcaaccgttagatgtagaggtaaaaagacgaagctcattagacaagcgaatgagggacgaaaacgtggaggaggtattaagtttggagaaatggagagagactgtttaatagcgcatggcgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagttaaattagatttcgaacgaaggcctccttcgttttataaaccattagataaagttgatctcaagccgtcttttctggtgtaa

SEQ ID NO: 306 - protein, 1164 aa, vaccinia virus
MKKNTDSEMDQRLGYKFLVPDPKAGVFYRPLHFQYVSYSNFILHRLHEILTVKRPLLSFKNNTERIMIEISNVKVTPPDYSPIIASIKGKSYDALATFTVNIFKEVMTKEGISITKISSYEGKDSHLIKIPLLIGYGNKNPLDTAKYLVPNVIGGVFINKQSVEKVGINLVEKITTWPKFRVVKPNSFTFSFSSVSPPNVLPTRYRHYKISLDISQLEALNISSTKTFITVNIVLLSQYLSRVSLEFIRRSLSYDMPPEVVYLVNAIIDSAKRITESITDFNIDTYINDLVEAEHIKQKSQLTINEFKYEMLHNFLPHMNYTPDQLKGFYMISLLRKFLYCIYHTSRYPDRDSMVCHRILTYGKYFETLAHDELENYIGNIRNDIMNNHKNRGTYAVNIHVLTTPGLNHAFSSLLSGKFKKSDGSYRTHPHYSWMQNISIPRSVGFYPDQVKISKMFSVRKYHPSQYLYFCSSDVPERGPQVGLVSQLSVLSSITNILTSEYLDLEKKICEYIRSYYKDDISYFETGFPITIENALVASLNPNMICDFVTDFRRRKRMGFFGNLEVGITLVRDHMNEIRINIGAGRLVRPFLVVDNGELMMDVCPELESRLDDMTFSDIQKEFPHVIEMVDIEQFTFSNVCESVQKFRMMSKDERKQYDLCDFPAEFRDGYVASSLVGINHNSGPRAILGCAQAKQAISCLSSDIRNKIDNGIHLMYPERPIVISKALETSKIAANCFGQHVTIALMSYKGINQEDGIIIKKQFIQRGGLDIVTAKKHQVEIPLENFNNKERDRSNAYSKLESNGLVRLNAFLESGDAMARNISSRTLEDDFARDNQISFDVSEKYTDMYKSRVERVQVELTDKVKVRVLTMKERRPILGDKFTTRTSQKGTVAYVADETELPYDENGITPDVIINSTSIFSRKTISMLIEVILTAAYSAKPYNNKGENRPVCFPSSNETSIDTYMQFAKQCYEHSNPKLSDEELSDKIFCEKILYDPETDKPYASKVFFGPIYYLRLRHLTQDKATVRCRGKKTKLIRQANEGRKRGGGIKFGEMERDCLIAHGAANTITEVLKDSEEDYQDVYVCENCGDIAAQIKGINTCLRCSKLNLSPLLTKIDTTHVSKVFLTQMNARGVKVKLDFERRPPSFYKPLDKVDLKPSFLV

SEQ ID NO: 307 - DNA, 195 bp, vaccinia virus
  CDS (1)...(195)
atgtcgaaccagaacatcccccagctttctgaatatcagacttcagtatcccaagtagcagttacacctccaccaaaacctgaaactccacagattttcgaatatcagacgtccgattctatagttaacaatccacgcccattttataattcggatctcgaatttgatgatattgatatgtatctactaccaaac

SEQ ID NO: 308 - protein, 65 aa, vaccinia virus
MSNQNIPQLSEYQTSVSQVAVTPPPKPETPQIFEYQTSDSIVNNPRPFYNSDLEFDDIDMYLLPN

SEQ ID NO: 309 - DNA, 462 bp, vaccinia virus
  CDS (1)...(462)
atggaaacaatcaaagcgttggagaaatttatggagttcgatcgccttcagaaagactgctctgataaactcgatagagagagggaaagacgcatgaaggctgaacgtgaaatcgctcgtaaaaactgcggaggtaacccatgcgaacgtgaattgaaatctgaacgtagtaacgtgaagaggttggaatatcaactagatgctgagaaagaaaaagttaagttctacaaaagagaactagaacgtgatcggtatctttctagtagatatcttacctcttcttcagatccacatgagaaaccattaccaaattatacatttcctcgcattaaaaatgtatctccgttgacaactgaggctacaggttctgtagaagtagcacctccatccacagacgttaccgaaccgattagtgatgtgacaccatcggtggatgtcgaaccagaacatcccccagctttc

SEQ ID NO: 310 - protein, 154 aa, vaccinia virus
METIKALEKFMEFDRLQKDCSDKLDRERERRMKAEREIARKNCGGNPCERELKSERSNVKRLEYQLDAEKEKVKFYKRELERDRYLSSRYLTSSSDPHEKPLPNYTFPRIKNVSPLTTEATGSVEVAPPSTDVTEPISDVTPSVDVEPEHPPAF

SEQ ID NO: 311 - DNA, 684 bp, vaccinia virus
  CDS (1)...(684)
atgaaaccaatgccgaaacagagagagatgcgacgtcttagagatagaatctcagatattgaaagacagttgagtgactgcagacgtaataatgaaagcaatgctgatatggaaagagagatgcaacgtcttagagatagaatcatggatcttgatagacagcttaacgagtgtaaacgcaacggtaacggagcatcttccgaggaggtaaataggctaaagactagaatcagggatcttgaacgatctctagagatctgctcaaaggatgaatcagaactctattcggcatataaaactaaactcggacgtgctagggaacaaattagtaacttgcaagaaagtctacgtagagagcgtgaatctgacaaaacagatagttactacaggagggaattgactcgcgaaagaaataaaatcgtagaattggaaaaagaacttaataagtgtttcgatgccaagtacatcgacgaaatcaattccaagaaaacccgtatttctgatctcgaacgacaactagcagcctgtaaatctaatggtggtagcaatggaaacatggaccaatacaaacgggaaattgaatctcttaaacgcgagctcgccgagtgtagacgtggtaacaatggatcccatagtgattgtaagtactatgacgaagaagcaagagattgtgttaagagctga

SEQ ID NO: 312 - protein, 227 aa, vaccinia virus
MKPMPKQREMRRLRDRISDIERQLSDCRRNNESNADMEREMQRLRDRIMDLDRQLNECKRNGNGASSEEVNRLKTRIRDLERSLEICSKDESELYSAYKTKLGRAREQISNLQESLRRERESDKTDSYYRRELTRERNKIVELEKELNKCFDAKYIDEINSKKTRISDLERQLAACKSNGGSNGNMDQYKREIESLKRELAECRRGNNGSHSDCKYYDEEARDCVKS

SEQ ID NO: 313 - DNA, 2163 bp, vaccinia virus
  CDS (1)...(2163)
atggaggtcacgaaccttattgaaaaatgtaccaagcactccaaagatttcgccactgaggtagaaaaactatggaacgatgagttgagttctgaatcaggtctctcaagaaaaacaagaaatgtaattcgtaatattcttcgtgatatcactaagtcattaactacagataagaaatcaaagtgtttccgtatactagaacgttcgacgattaacggagagcagattaaagatgtatataaaactatttttaataatggtgttgatgtggagtctagaatcaacactacaggaaagtatgttctatttacagttatgacttatgttgctgctgaactacgactcattaagtcagacgagatattcgctcttctatcaagattttttaacatgatatgtgatattcatagaaaatacggatgtggtaatatgtttgttggtattcctgctgctctaattattctgttggaaattgatcacatcaataaactgtttagcgtgtttagtacaagatatgacgccaagacatacctatacactgaatattttcttttccttaacattaatcattatctacttagtggttcagatttatttatcaacgtagcatatggtgctgtatctttttcgtcacccattagtgttccagattatatcatggaagcactgacatttaaggcatgtgatcatattatgaaatctggagatctaaaatatacatatgcgtttactaaaaaggttaaggatctgtttaatactaaatctgattctgtttatcaatacgttagacttcatgaaatgtcatatgatggtgtttcagaagatacggatgatgacgatgaggtattcgctatccttaacttgagtattgattccagcgttgatagatacagaaacagagttcttctactaactcccgaagtcgcgtctcttagaaaagaatattctgaagtagaacccgattataaatacttgatggatgaggaagtgcccgcgtacgacaagcatttgcctaagcctattactaacactggtattgaagaaccacacgctactggaggagatgaggaccaaccaattaaggttgtccatccccctaataatgataaagatgatgctatcaagccatacaatccattagaagatcctaattatgttcccacaattacaagaacggctataggaatcgctgattaccaactagttattaataaactaattgaatggttagataaatgcgaggaagaatgcggaaatagtggagagtttaaaacagagttggaagaagccaagagaaaactcaccgaattgaatgcagaacttagtgataaactcagtaagattaggactttggaaagggattctgtttataaaaccgaaagaatcgaccgacttacaaaagagatcaaagaacacagggatattcaaaatgggacagatgatggttcagatttattagaaattgataagaagactatccgagaattgagagaatcgcttgatagggaacgagaaatgcgttcagaactagaaaaggaactggatactattaggaatggaaaagtagatggatcttgtcaacgagaacttgaactcagtcgtatgtggctaaaacaacgcgatgacgatctccgagctgaaatcgataaacgtcgtaatgtcgaatgggaactgtccagacttcgtagggatatcaaggaatgcgacaaatacaaggaggatcttgataaggccaagacaaatattagtaactacgtaagcaaaatcagtactctagaatcagaaattgctaaatatcaacaagatagggacacgctttctgtagtacgcagagaacttgaggaagaacgacgacgcgttagagatctcgatgaatgtacacgcaaccaggaagacacgcaagaagttgatgcactgcgttcgcgtattagagaactagagaataagttgaccgactgcatcgagagcggaggaggaaatcttacagagattagcagactccaatctaaaatctcagatcttgaaagacaactgagtgaatgccgtgaaaatgctacagagattagcagactccaatctagaatatcagatcttgaaagacagttgaacgactgtagacgtaataatgaaaccaatgccgaaacagagagagatgcgacgtct

SEQ ID NO: 314 - protein, 721 aa, vaccinia virus
MEVTNLIEKCTKHSKDFATEVEKLWNDELSSESGLSRKTRNVIRNILRDITKSLTTDKKSKCFRILERSTINGEQIKDVYKTIFNNGVDVESRINTTGKYVLFTVMTYVAAELRLIKSDEIFALLSRFFNMICDIHRKYGCGNMFVGIPAALIILLEIDHINKLFSVFSTRYDAKTYLYTEYFLFLNINHYLLSGSDLFINVAYGAVSFSSPISVPDYIMEALTFKACDHIMKSGDLKYTYAFTKKVKDLFNTKSDSVYQYVRLHEMSYDGVSEDTDDDDEVFAILNLSIDSSVDRYRNRVLLLTPEVASLRKEYSEVEPDYKYLMDEEVPAYDKHLPKPITNTGIEEPHATGGDEDQPIKVVHPPNNDKDDAIKPYNPLEDPNYVPTITRTAIGIADYQLVINKLIEWLDKCEEECGNSGEFKTELEEAKRKLTELNAELSDKLSKIRTLERDSVYKTERIDRLTKEIKEHRDIQNGTDDGSDLLEIDKKTIRELRESLDREREMRSELEKELDTIRNGKVDGSCQRELELSRMWLKQRDDDLRAEIDKRRNVEWELSRLRRDIKECDKYKEDLDKAKTNISNYVSKISTLESEIAKYQQDRDTLSVVRRELEEERRRVRDLDECTRNQEDTQEVDALRSRIRELENKLTDCIESGGGNLTEISRLQSKISDLERQLSECRENATEISRLQSRISDLERQLNDCRRNNETNAETERDATS

SEQ ID NO: 315 - DNA, 1503 bp, vaccinia virus
  CDS (1)...(1503)
atggcgaacattataaatttatggaacggaattgtaccaacggttcaagatgttaatgttgcgagcattactgcgtttaaatctatgatagatgaaacatgggataaaaaaatcgaagcaaatacatgcatcagtagaaaacatagaaacattattcacgaagttattagggactttatgaaagcctatcctaaaatggatgagaataaaaaatctccattaggagccccaatgcaatggctaacacaatattatattttaaagaatgaatatcataagaccatgctagcgtatgataatggatcattgaatacaaaatttaaaacgttaaacatttatatgattactaacgttggtcaatatattttatatatagtattttgtataatatctggtaagaatcacgatggtactccttatatatacgattctgagataacgagcaatgataaaaatcttattaatgagcgtatcaagtatgcatgtaagcaaatattacacggtcaattaactatagctctgagaattagaaataaattcatgtttataggatcacccatgtatttatggtttaacgtaaacgggtcacaggtatatcatgatatatatgatcgtaatgccggttttcataataaagagataggtagactactatacgcatttatgtactatctatctataagtggtagatttttgaatgatttcgcactattaaagtttacgtatttaggagaatcctggacatttagtttgagtgttcctgaatatatattatatggtttaggatattctgttttcgatactattgaaaaatttagcaatgatgctatactcgtttatattagaacaaacaatagaaatggatatgattatgtagagtttaataaaaaaggaattgctaaggtgacagaagctaaacccgataacgataagcgaattcatgctataagactcatcaacgatagtagtgatgttcaacatatacattttggatttagaaatatggtaataatagacaatgaatgcgctaatattcagtcgagtgctgaaaatgcaactgatacaggacatcatcaagatagcaaaataaatatcgaagtcgaagatgatgtcatagacgatgatgattataatccaaaacccactccgataccggagcctcaccctagaccaccgtttcccagacatgaatatcataagaggccgaaacttcttcctgtagaagaacctgatcctgtcaaaaaagacgcggatcgtataagacttgataatcatatattaaacacattggatcataatcttaatttcatcggacactattgttgtgatacagcggcagttgataggttagaacatcacatcgaaacattgggacaatatgcagtaatactggcaagaaagataaatatgcaaacattactgttcccatggccattacctactgtccatccacatgcgatagatggtagtattccaccacatgggagatctacgattttataa

SEQ ID NO: 316 - protein, 500 aa, vaccinia virus
MANIINLWNGIVPTVQDVNVASITAFKSMIDETWDKKIEANTCISRKHRNIIHEVIRDFMKAYPKMDENKKSPLGAPMQWLTQYYILKNEYHKTMLAYDNGSLNTKFKTLNIYMITNVGQYILYIVFCIISGKNHDGTPYIYDSEITSNDKNLINERIKYACKQILHGQLTIALRIRNKFMFIGSPMYLWFNVNGSQVYHDIYDRNAGFHNKEIGRLLYAFMYYLSISGRFLNDFALLKFTYLGESWTFSLSVPEYILYGLGYSVFDTIEKFSNDAILVYIRTNNRNGYDYVEFNKKGIAKVTEAKPDNDKRIHAIRLINDSSDVQHIHFGFRNMVIIDNECANIQSSAENATDTGHHQDSKINIEVEDDVIDDDDYNPKPTPIPEPHPRPPFPRHEYHKRPKLLPVEEPDPVKKDADRIRLDNHILNTLDHNLNFIGHYCCDTAAVDRLEHHIETLGQYAVILARKINMQTLLFPWPLPTVHPHAIDGSIPPHGRSTIL

SEQ ID NO: 317 - DNA, 330 bp, vaccinia virus
  CDS (1)...(330)
atggacggaactcttttccccggagatgacgatcttgcaattccagcaactgaatttttttctacaaaggctgctaaaaagccagaggctaaacgcgaagcaattgttaaagccgatgaagacgacaatgaggaaactctcaaacaacggctaactaatttggaaaaaaagattactaatgtaacaacaaagtttgaacaaatagaaaagtgttgtaaacgcaacgatgaagttctatttaggttggaaaatcacgctgaaactctaagagcggctatgatatctctggctaaaaagattgatgttcagactggacggcgtccatatgag

SEQ ID NO: 318 - protein, 110 aa, vaccinia virus
MDGTLFPGDDDLAIPATEFFSTKAAKKPEAKREAIVKADEDDNEETLKQRLTNLEKKITNVTTKFEQIEKCCKRNDEVLFRLENHAETLRAAMISLAKKIDVQTGRRPYE

SEQ ID NO: 319 - DNA, 441 bp, vaccinia virus
  CDS (1)...(441)
atgaactctctatcaattttttttattgtggtagcgacggctgcggtgtgtttactttttatccagggttactcaatatatgaaaattatggcaatattaaggaatttaatgctactcatgcagcattcgaatattcaaaatctataggtggaacaccggcattagataggagagttcaagatgtcaacgacacaatttctgatgtaaagcaaaagtggagatgtgtggtttatccaggaaacggttttgtatccgcttccatatttggatttcaggcagaagttggacccaataatactagatccattagaaaatttaacacgatgcaacaatgtatagactttacattttctgatgttattaacatcgatatttataatccatgtgttgtaccaaatataaataacgcagagtgtcagtttctaaaatctgtactttaa

SEQ ID NO: 320 - protein, 146 aa, vaccinia virus
MNSLSIFFIVVATAAVCLLFIQGYSIYENYGNIKEFNATHAAFEYSKSIGGTPALDRRVQDVNDTISDVKQKWRCVVYPGNGFVSASIFGFQAEVGPNNTRSIRKFNTMQQCIDFTFSDVINIDIYNPCVVPNINNAECQFLKSVL

SEQ ID NO: 321 - DNA, 915 bp, vaccinia virus
  CDS (1)...(915)
atgcagcatccgcgggaagagaattcaatcgtcgttgaactcgaaccctcattggctacatttatcaaacaaggatttaataatctcgtaaaatggcccttgttaaacattggaatagttttgtctaatacatctaccgctgtcaatgaggaatggataactgcggtagagcatattcccaccatgaagatattttacaaacatatacataagatacttactagagaaatggggtttttagtctatttgaaaagatcccaatctgaacgcgataattatataactttatacgattttgattattatattatagataaggatacaaattctgtaactatggtagataaaccgaccgagttaaaggaaactttgttacatgtatttcaagaatatcgtttaaagagttctcaaacaatagagcttatagcgtttagttcaggtacggtaataaacgaagacatagtttcaaaattaacatttttagatgtggaggtatttaatagagaatataataatgttaaaactatcatagatccggattttgtatctagatctccatttatagttatctctcctatgggtaaactaactttcttcgtagaagtatattcgtggtttgattttaaatcgtgtttcaaagatattatagatttcttagaaggtgctctaatagccaatattcataatcacatgattaaggtaggtaattgtgacgaaacagtatcgtcttataatccagagtctggaatgttgtttgttaatgacttaatgactatgaacatagtcaactttttcggatgtaattctaggttagaatcataccatcggttcgatatgacaaaagtagatgttgaactatttattaaagcattgtctgatgcgtgtaaaaaaattttgtcagcttctaatagatta

SEQ ID NO: 322 - protein, 305 aa, vaccinia virus
MQHPREENSIVVELEPSLATFIKQGFNNLVKWPLLNIGIVLSNTSTAVNEEWITAVEHIPTMKIFYKHIHKILTREMGFLVYLKRSQSERDNYITLYDFDYYIIDKDTNSVTMVDKPTELKETLLHVFQEYRLKSSQTIELIAFSSGTVINEDIVSKLTFLDVEVFNREYNNVKTIIDPDFVSRSPFIVISPMGKLTFFVEVYSWFDFKSCFKDIIDFLEGALIANIHNHMIKVGNCDETVSSYNPESGMLFVNDLMTMNIVNFFGCNSRLESYHRFDMTKVDVELFIKALSDACKKILSASNRL

SEQ ID NO: 323 - DNA, 234 bp, vaccinia virus
  CDS (1)...(234)
atggaagaccttaacgaggcaaacttctcacatttattgataaatttatctaataataaagatatcgatgcgcaatacgcgtctacattatccgtggtacatgaattgctatccgctataaattttaaaatatttaatataaacaaaaagtcgaaaaagaattccaaatcaatcgaacaacatcccgtcgttcatcatgcagcatccgcgggaagagaattcaatcgtcgttga

SEQ ID NO: 324 - protein, 77 aa, vaccinia virus
MEDLNEANFSHLLINLSNNKDIDAQYASTLSVVHELLSAINFKIFNINKKSKKNSKSIEQHPVVHHAASAGREFNRR

SEQ ID NO: 325 - DNA, 375 bp, vaccinia virus
  CDS (1)...(375)
atggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaatgatctaaagatgatgctattttacatggatttatcatatcatggagtgacaagtagtggagcaatttacaaattgggatcgtctatcgatagactttctctaaataggactattgttacaaaagttaataattatgatgatacattttttgacgacgatgattga

SEQ ID NO: 326 - protein, 124 aa, vaccinia virus
MASILNTLRFLEKTSFYNCNDSITKEKIKIKHKGMSFVFYKPKHSTVVKYLSGGGIYHDDLVVLGKVTINDLKMMLFYMDLSYHGVTSSGAIYKLGSSIDRLSLNRTIVTKVNNYDDTFFDDDD

SEQ ID NO: 327 - DNA, 810 bp, vaccinia virus
  CDS (1)...(810)
atgaattgtttccaagaaaaacaattttcaagagaaaatttattaaaaatgccgtttagaatggttttaacgggaggatctggatctggaaaaactatctatttactatctctgttttctacactagttaaaaaatataaacatatattcttgtttacacccgtttataacccagattatgatggatacatttggccaaatcatattaatttcgttagtagtcaggaagctctagaatataatctgatacgaactaaaagtaacatagaaaaatgtattgctgtcgcacaaaatcataaaaaatcagcacactttttacttatttttgatgatgtaggcgataaactatcaaaatgcaatactctaatagaattcttaaactttggaaggcatttaaacacgtctattattctactatgccaaacttatagacacgtaccaatattaggacgggctaacattacgcatttttgtagttttaacatttccatctcagacgcggaaaatatgctacgatcgatgcctgtaaaggggaaacgaaaggatatattaaacatgttgaatatgatacagacagctagatccaataatcgattggctattattatcgaagactccgtattttgtgaaggtgaattacgtatatgtaccgataccgccgataaggacgttatagaacaaaagttaaacatagatattttagtaaatcaatattctcatatgaaaaagaacctaaacactatattagaaagtacaaaaacaaaattgtgcaatagcgatcaatcatcgtcgtcaaaaaatgtatcatca

SEQ ID NO: 328 - protein, 270 aa, vaccinia virus
MNCFQEKQFSRENLLKMPFRMVLTGGSGSGKTIYLLSLFSTLVKKYKHIFLFTPVYNPDYDGYIWPNHINFVSSQEALEYNLIRTKSNIEKCIAVAQNHKKSAHFLLIFDDVGDKLSKCNTLIEFLNFGRHLNTSIILLCQTYRHVPILGRANITHFCSFNISISDAENMLRSMPVKGKRKDILNMLNMIQTARSNNRLAIIIEDSVFCEGELRICTDTADKDVIEQKLNIDILVNQYSHMKKNLNTILESTKTKLCNSDQSSSSKNVSS

SEQ ID NO: 329 - DNA, 558 bp, vaccinia virus
  CDS (1)...(558)
atgatgacaccagaaaacgacgaagagcagacatctgtgttctccgctactgtttacggagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacacaatatgatcacaaagaaagctgtaatggtttatattaccagggttcttgttatatattacattcagactaccagttattctcggatgctaaagcaaattgcactgcggaatcatcaacactacccaataaatccgatgtcttgattacctggctcattgattatgttgaggatacatggggatctgatggtaatccaattacaaaaactacatccgattatcaagattctgatgtatcacaagaagttagaaagtatttttgtgttaaaacaatgaactaa

SEQ ID NO: 330 - protein, 185 aa, vaccinia virus
MMTPENDEEQTSVFSATVYGDKIQGKNKRKRVIGLCIRISMVISLLSMITMSAFLIVRLNQCMSANEAAITDAAVAVAAASSTHRKVASSTTQYDHKESCNGLYYQGSCYILHSDYQLFSDAKANCTAESSTLPNKSDVLITWLIDYVEDTWGSDGNPITKTTSDYQDSDVSQEVRKYFCVKTMN

SEQ ID NO: 331 - DNA, 507 bp, vaccinia virus
  CDS (1)...(507)
atgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagccagattgcctagaccggatactagacatctgagagtattgtttagtattttttataaagattattgggtaagtttaaaaaagaccaataataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtga

SEQ ID NO: 332 - protein, 168 aa, vaccinia virus
MKSLNRQTVSRFKKLSVPAAIMMILSTIISGIGTFLHYKEELMPSACANGWIQYDKHCYLDTNIKMSTDNAVYQCRKLRARLPRPDTRHLRVLFSIFYKDYWVSLKKTNNKWLDINNDKDIDISKLTNFKQLNSTTDAEACYIYKSGKLVKTVCKSTQSVLCVKKFYK

SEQ ID NO: 333 - DNA, 531 bp, vaccinia virus
  CDS (1)...(531)
atggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggattataattgatgggaaatgcaatagtaattttttatcataa

SEQ ID NO: 334 - protein, 176 aa, vaccinia virus
MDAAFVITPMGVLTITDTLYDDLDISIMDFIGPYIIGNIKTVQIDVRDIKYSDMQKCYFSYKGKIVPQDSNDLARFNIYSICAAYRSKNTIIIACDYDIMLDIEDKHQPFYLFPSIDVFNATIIEAYNLYTAGDYHLIINPSDNLKMKLSFNSSFCISDGNGWIIIDGKCNSNFLS

SEQ ID NO: 335 - DNA, 666 bp, vaccinia virus
  CDS (1)...(666)
atgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtaattaatgaaacggagactgttaaagtacttaatgaagataccaaacagaatcctaactattcatccaatcctttcgtaaattataataaaaccagtatttgtagcaagtcaaatccgtttattacagaacttaacaataaatttagtgagaataatccgtttagacgagcacatagcgatgattatcttaataagcaagaacaagatcatgaacacgatgatatagaatcatcggtcgtatcattggtgtga

SEQ ID NO: 336 - protein, 221 aa, vaccinia virus
MMLVPLITVTVVAGTILVCYILYICRKKIRTVYNDNKIIMTKLKKIKSSNSSKSSKSTDSESDWEDHCSAMEQNNDVDNISRNEILDDDSFAGSLIWDNESNVMAPSTEHIYDSVAGSTLLINNDRNEQTIYQNTTVVINETETVKVLNEDTKQNPNYSSNPFVNYNKTSICSKSNPFITELNNKFSENNPFRRAHSDDYLNKQEQDHEHDDIESSVVSLV

SEQ ID NO: 337 - DNA, 792 bp, vaccinia virus
  CDS (1)...(792)
atggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacgtcaatggcaaaaatattctaacctttcccattgatcatgctgtaatcatatccccactgagtaaatgtgtcgtagttagcaagggtcctacaaccatattggttgttaaagcggatatacccagcaaacgattggtaacatcgtttacaaacgacatactatatgtaaacaatctgtcactgattaattatttgccgttgtctgtattcattattagacgagttaccgactatttggatagacacatatgcgatcagatatttgcgaataataagtggtattccattataaccatcgacaataagcagtttcctattccatcaaactgtataggtatgtcctctgccaagtacataaattctagcatcgagcaagatactttaatacatgtttgtaacctcgagcatccattcgacttagtatacaaaaaaatgcagtcgtacaattctgtacctatcaaggaacaaatattgtacggtagaattgataatataaatatgagcattagtatttctgtgtattaa

SEQ ID NO: 338 - protein, 263 aa, vaccinia virus
MEIFPVFGISKISNFIANNDCRYYIDTEHQKIISDEINRQMDETVLLTNILSVEVVNDNEMYHLIPHRLSTIILCISSVGGCVISIDNDVNGKNILTFPIDHAVIISPLSKCVVVSKGPTTILVVKADIPSKRLVTSFTNDILYVNNLSLINYLPLSVFIIRRVTDYLDRHICDQIFANNKWYSIITIDNKQFPIPSNCIGMSSAKYINSSIEQDTLIHVCNLEHPFDLVYKKMQSYNSVPIKEQILYGRIDNINMSISISVY

SEQ ID NO: 339 - DNA, 189 bp, vaccinia virus
  CDS (1)...(189)
atggattcattctcttctctttttatgaaactctgttgtatatctactgataaaactggaagcaaaaaatctgataaaaagaataagaataagatcaaggattatatggaacacgattattataaaataacaatagttcctggttcctcttccacgtctactagctcgtggtattatacacatgcctag

SEQ ID NO: 340 - protein, 62 aa, vaccinia virus
MDSFSSLFMKLCCISTDKTGSKKSDKKNKNKIKDYMEHDYYKITIVPGSSSTSTSSWYYTHA

SEQ ID NO: 341 - DNA, 831 bp, vaccinia virus
  CDS (1)...(831)
atgtcaagagttagaatatcgttgatatacctctatacgttggttgttataacaactacaaagaccatagagtatacagcatgtaatgataccatcattattccgtgtactatagataatccgacaaagtatattagatggaaattggataaccatgatattttaacttataataaaacttccaagacgaccatattaagtaaatggcatactagtgctagacttcattcgttatcggatagtgatgtctcattgattatagaatataaagatatcttaccaggtacgtatacatgcggggataatactggaataaaatctactgtgaaattagttcaacttcatactaattggtttaatgattaccaaacaatgttgatgtttatctttacgggcattactttattcttattatttctcgagatcacttatacatcgatatccgttgtattttctactaatttaggaatcttacaagtatttggttgtgttattgccatgatagagttatgcggagcatttttgttttatccgtcaatgtttactctcaggcatattatcggattgttgatgatgacattaccgtctatatttcttataattactaaagtgttttcattttggttactgtgtaaattatcatgtgctgtacacctcattatctactatcaattggccggatacattttaacggttttgggtttgggattgagtttaaaggaatgtgttgatggaactctgttattatctgggttgggaactattatggtgtctgaacattttagcctgttatttctagtctgctttccatcaacgcaaagagactattac

SEQ ID NO: 342 - protein, 277 aa, vaccinia virus
MSRVRISLIYLYTLVVITTTKTIEYTACNDTIIIPCTIDNPTKYIRWKLDNHDILTYNKTSKTTILSKWHTSARLHSLSDSDVSLIIEYKDILPGTYTCGDNTGIKSTVKLVQLHTNWFNDYQTMLMFIFTGITLFLLFLEITYTSISVVFSTNLGILQVFGCVIAMIELCGAFLFYPSMFTLRHIIGLLMMTLPSIFLIITKVFSFWLLCKLSCAVHLIIYYQLAGYILTVLGLGLSLKECVDGTLLLSGLGTIMVSEHFSLLFLVCFPSTQRDYY

SEQ ID NO: 343 - DNA, 399 bp, vaccinia virus
  CDS (1)...(399)
atgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatataacaacatctataaaagtagaggatgcggataaggatacattagtatgcggaaccaataacggaaatcccaaatgttggaaaatagacggttcagacgacccaaaacatagaggtagaggatacgctccttatagcaaagtaacgataatcagttacaacgaatgtgtactatctgacataaacatatcaaaagaaggaattaaacgatag

SEQ ID NO: 344 - protein, 132 aa, vaccinia virus
MIPLLFILFYFANGIEWHKFETSEEIISTYLLDDVLYTGVNGAVYTFSNNKLNKTGLTNNNYITTSIKVEDADKDTLVCGTNNGNPKCWKIDGSDDPKHRGRGYAPYSKVTIISYNECVLSDINISKEGIKR

SEQ ID NO: 345 - DNA, 429 bp, vaccinia virus
  CDS (1)...(429)
atgaataccattaaacaatctttttctacgtcaaaattggaaggatatacaaagcaattgccgtctccagctcctggtatatgtctaccagctggaaaagttgttccacataccacgtttgaagtcatagaaaaatataatgtactagatgatattataaagcctttatctaaccaacctatcttcgaaggaccgtctggcgttaaatggttcgatataaaggagaaggaaaatgaacatcgggaatatagaatatacttcataaaagaaaattctatatattcattcgatacaaaaactaaacaaactcgcagtgcacaagtcaatgcacaactattttcagtaatggtaactgcgaaaccgttatttatagcagatatagggataggagtaggaatgccacaaatgaaaaaaatacttaaaatgtaa

SEQ ID NO: 346 - protein, 142 aa, vaccinia virus
MNTIKQSFSTSKLEGYTKQLPSPAPGICLPAGKVVPHTTFEVIEKYNVLDDIIKPLSNQPIFEGPSGVKWFDIKEKENEHREYRIYFIKENSIYSFDTKTKQTRSAQVNAQLFSVMVTAKPLFIADIGIGVGMPQMKKILKM

SEQ ID NO: 347 - DNA, 507 bp, vaccinia virus
  CDS (1)...(507)
atgaacaaacataagacagattatgctggttatgcttgctgcgtaatatgcggtctaattgttggaattatttttacagcgacactattaaaagttgtagaacgtaaattagttcatacaccatcaatagataaaacgataaaagatgcatatattagagaagattgtcctactgactggataagctataataataaatgtatccatttatctactgatcgaaaaacctgggaggaaggacgtaatacatgcaaagctctaaatccaaattcggatctaattaagatagagactccaaacgagttaagttttttaagaagcattagacgcggatattgggtaggagaatccgaaatattaaaccagacaaccccatataattttatagctaagaatgccacgaagaatggaaatatatttgtagtacaacgaatactcccaaactgcattcgtgttacactatataacaattacactacatttttatcataccactacttcggttag

SEQ ID NO: 348 - protein, 168 aa, vaccinia virus
MNKHKTDYAGYACCVICGLIVGIIFTATLLKVVERKLVHTPSIDKTIKDAYIREDCPTDWISYNNKCIHLSTDRKTWEEGRNTCKALNPNSDLIKIETPNELSFLRSIRRGYWVGESEILNQTTPYNFIAKNATKNGNIFVVQRILPNCIRVTLYNNYTTFLSYHYFG

SEQ ID NO: 349 - DNA, 657 bp, vaccinia virus
  CDS (1)...(657)
atgtactcgttattatttattattttgatgtgtataccatttagttttcaaacagtgtatgatgataaatcggtatgcgattctgacaataaagaatatatgggaatcgaagtttatgtagaagcaacactagacgaacacctcagacaaacaacgtgtgaatccgaaatccataaatatggtgcatctgtatcaaacggaggattaaatatttctgttgatttattaaactgttttcttaattttcatacagttggtgtatacactaatcgcgataccgtatacgcgaagtttgctagtttggatccatggactacggaacctataaattctatgacccatgacgatctagtaaaattaacaaaagaatgtatagtggacatttatttaaaatgtgaagtggataaaacaaaggatttcatgaaaactaatggcaatagattaaaaccaagagactttaaaactgttcctccttctgatgtaggaagcatgatagaactacagtctgactattgcgtaaacgatgtgactgcatacgtcaaaatatacgatgagtgcggaaacattaaacagcattccattccaacactaagagattattttaccaccaagaatggtcaaccacgtaaaatattaaagaaaaaatttgataattgt

SEQ ID NO: 350 - protein, 219 aa, vaccinia virus
MYSLLFIILMCIPFSFQTVYDDKSVCDSDNKEYMGIEVYVEATLDEHLRQTTCESEIHKYGASVSNGGLNISVDLLNCFLNFHTVGVYTNRDTVYAKFASLDPWTTEPINSMTHDDLVKLTKECIVDIYLKCEVDKTKDFMKTNGNRLKPRDFKTVPPSDVGSMIELQSDYCVNDVTAYVKIYDECGNIKQHSIPTLRDYFTTKNGQPRKILKKKFDNC

SEQ ID NO: 351 - DNA, 402 bp, vaccinia virus
  CDS (1)...(402)
atggctgaatggcataaaattatcgaggatatctcaaaaaataataagttcgaggatgccgccatcgttgattacaagactacaaagaatgttctagctgctattcctaacagaacatttgccaagattaatccgggtgaaattattcctctcatcactaatcgtaatattctaaaacctcttattggtcagaaatattgtattgtatatactaactctctaatggacgagaacacgtatgctatggagttgcttactgggtacgcccctgtatctccgatcgttatagcgagaactcataccgcacttatatttttgatgggtaagccaacaacatccagacgtgacgtgtatagaacgtgtagagatcacgctacccgtgtacgtgcaactggtaattaa

SEQ ID NO: 352 - protein, 133 aa, vaccinia virus
MAEWHKIIEDISKNNKFEDAAIVDYKTTKNVLAAIPNRTFAKINPGEIIPLITNRNILKPLIGQKYCIVYTNSLMDENTYAMELLTGYAPVSPIVIARTHTALIFLMGKPTTSRRDVYRTCRDHATRVRATGN

SEQ ID NO: 353 - DNA, 585 bp, vaccinia virus
  CDS (1)...(585)
atgatgatgatgaaatggataatatccatattgacgatgtcaataatgccggtattggcatacagctcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccaagtgtattattataataggatatgattctattatatggtataaagatataaatgacaagtataatggcatctatgattttactgcaatatgtatgctaatagcgtctacattgatagtgaccatatacgtgtttaaaaaaataaaaatgaactcttaa

SEQ ID NO: 354 - protein, 194 aa, vaccinia virus
MMMMKWIISILTMSIMPVLAYSSSIFRFHSEDVELCYGHLYFDRIYNVVNIKYNPHIPYRYNFINRTLTVDELDDNVFFTHGYFLKHKYGSLNPSLIVSLSGNLKYNDIQCSVNVSCLIKNLATSTSTILTSKHKTYSLHRSKCIIIIGYDSIIWYKDINDKYNGIYDFTAICMLIASTLIVTIYVFKKIKMNS

SEQ ID NO: 355 - DNA, 1038 bp, vaccinia virus
  CDS (1)...(1038)
atggccgtgtacgcggttactggtggtgccggatttctaggcaggtatatagtaaaactgttaattagtgcagatgatgttcaagaaatcagagtcatagatattgtagaagatccacaaccaataacctcgaaagttaaggttataaactatatacaatgtgatataaacgactttgataaggtgagagaagcgctaaatggggtaaatctgattattcatacagctgctctagtggatgtatttggaaaatacaccgataatgaaatcatgaaagtaaactattatggaacacagactattttggcagcttgtgtggacctaggaatcaagtatttgatctatactagtagcatggaagcaataggacccaataaacacggtgatccattcatcggccatgagcataccctttatgatatatcaccaggacatgtatacgcaaaaagtaaacgtatggccgagcaactggttatgaaagccaataattccgtaatcatgaatggagcaaaattgtatacttgttgcctaagacccactggaatttacggagaaggagacaaattgacgaaagtcttttacgagcaatgtaagcaacacggtaacattatgtatcgtacagtcgatgataacgcggtacatagccgggtatatgtaggaaatgctgcatggatgcacgtgttggctgcaaaatatatccagtatccgggatctaagattaaaggaaatgcttacttttgctacgattactctccatcgtgttcgtacgatatgtttaatcttctattgatgaaaccattgggaatagaacaaggatctaggattccaagatggatgctaaaaatgtacgcgtgcaagaatgatatgaagagaattctatttagaaaaccatcactactcaacaactatacgttgaagatatccaacactacatttgaggtgcgtaccaacaatgcagaactagatttcaactactcccctatctttgacgtcgatgtggcattcgaacgaacacggaaatggttagaagaatcagaa

SEQ ID NO: 356 - protein, 346 aa, vaccinia virus
MAVYAVTGGAGFLGRYIVKLLISADDVQEIRVIDIVEDPQPITSKVKVINYIQCDINDFDKVREALNGVNLIIHTAALVDVFGKYTDNEIMKVNYYGTQTILAACVDLGIKYLIYTSSMEAIGPNKHGDPFIGHEHTLYDISPGHVYAKSKRMAEQLVMKANNSVIMNGAKLYTCCLRPTGIYGEGDKLTKVFYEQCKQHGNIMYRTVDDNAVHSRVYVGNAAWMHVLAAKYIQYPGSKIKGNAYFCYDYSPSCSYDMFNLLLMKPLGIEQGSRIPRWMLKMYACKNDMKRILFRKPSLLNNYTLKISNTTFEVRTNNAELDFNYSPIFDVDVAFERTRKWLEESE

SEQ ID NO: 357 - DNA, 378 bp, vaccinia virus
  CDS (1)...(378)
atggctgtttgtataataaaccacgataatatcagaggagttatttactttgaaccagttcatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatttacaattattggaaaggcgttatctatttcaaaaaatgatcagagattagcgtgtggagttattggtatttcttacataaatgaaaagataatacattttcttacaattaacgagaatggcgtttga

SEQ ID NO: 358 - protein, 125 aa, vaccinia virus
MAVCIINHDNIRGVIYFEPVHGKDKVLGSVIGLKSGTYSLIIHRYGDISQGCDSIGSPEIFIGNIFVNRYGVAYVYLDTDVNIFTIIGKALSISKNDQRLACGVIGISYINEKIIHFLTINENGV

SEQ ID NO: 359 - DNA, 723 bp, vaccinia virus
  CDS (1)...(723)
atggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgactccatagagataagaggggtgcttccagaggaaactaatattggttgcgcggttaatacgccggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaagtataggtgtatggcattagccgaacatatatctgatagtattccaatatctgagctatctagactacgatacaatctatgtaagtatctacgcgggcacactgagagcatagaggataaatttgattattttgaagacgatgattcgtctacatgttctgccgtaaccgacagggaaacggatgtataa

SEQ ID NO: 360 - protein, 240 aa, vaccinia virus
MAFDISVNASKTINALVYFSTQQNKLVIRNEVNDTHYTVEFDRDKVVDTFISYNRHNDSIEIRGVLPEETNIGCAVNTPVSMTYLYNKYSFKLILAEYIRHRNTISGNIYSALMTLDDLAIKQYGDIDLLFNEKLKVDSDSGLFDFVNFVKDMICCDSRIVVALSSLVSKHWELTNKKYRCMALAEHISDSIPISELSRLRYNLCKYLRGHTESIEDKFDYFEDDDSSTCSAVTDRETDV

SEQ ID NO: 361 - DNA, 732 bp, vaccinia virus
  CDS (1)...(732)
atgggtaacaaaaatattaaaccatctaaggaaaatagactgtccatcttgtccaaggataagatggattcatttaagagaggatcttgggcaacgtcatcctttagagaaaagtcgcgtgcaaccatccaaagattttcatctcttagacgagaacatattaaagtagaccatcctgacaagttcctggagttaaagagagagatatatgaaataattcagaaatcatcttctatagatgtggacaaacggactaagctcatgtccaacataaaaacgatgatgataaatccattcatgatcgagggtttaatgacatctttagaaaacttggatcccgataacaagatgagctactcatcggtgatgatattgggagaattcgacatcatcaatataagcgacaatgaggcggcattcgagttcataaacagtctgttgaaatctcttctcttgttaaatactagacaactaaaactcttggaatactccattagtaatgacttgttgtatgcccacataaatgcgttggagtatatcataaaaaatacatttaatgttccagaacggcaactgattctgagaggtcaatacctaactccaattttcagtgatttgttaaagtatgcgggtctaaccataaagtcaaacatacttatgtggaataaacagtttatcaaaccagtatctgacctctatacatctataagactcctttattgtgttacagta

SEQ ID NO: 362 - protein, 244 aa, vaccinia virus
MGNKNIKPSKENRLSILSKDKMDSFKRGSWATSSFREKSRATIQRFSSLRREHIKVDHPDKFLELKREIYEIIQKSSSIDVDKRTKLMSNIKTMMINPFMIEGLMTSLENLDPDNKMSYSSVMILGEFDIINISDNEAAFEFINSLLKSLLLLNTRQLKLLEYSISNDLLYAHINALEYIIKNTFNVPERQLILRGQYLTPIFSDLLKYAGLTIKSNILMWNKQFIKPVSDLYTSIRLLYCVTV

SEQ ID NO: 363 - DNA, 612 bp, vaccinia virus
  CDS (1)...(612)
atgtctcgtggggcattaatcgtttttgaaggattggacaaatctggaaaaacaacacaatgtatgaacatcatggaatctataccggcaaacacgataaaatatcttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattctctggagtagcgtatgccgccgctaaaggcgcgtcaatgactctcagtaagagttatgaatctggattgcctaaacccgacttagttatattcttggaatctggtagcaaagaaattaatagaaacgtcggcgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatg

SEQ ID NO: 364 - protein, 204 aa, vaccinia virus
MSRGALIVFEGLDKSGKTTQCMNIMESIPANTIKYLNFPQRSTVTGKMIDDYLTRKKTYNDHIVNLLFCANRWEFASFIQEQLEQGITLIVDRYAFSGVAYAAAKGASMTLSKSYESGLPKPDLVIFLESGSKEINRNVGEEIYEDVTFQQKVLQEYKKMIEEGDIHWQIISSEFEEDVKKELIKNIVIEAIHTVTGPVGQLWM

SEQ ID NO: 365 - DNA, 489 bp, vaccinia virus
  CDS (1)...(489)
atggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagatctatcagaccgaattgattaattcattagacgacaatgaaattatcgattgtatagttaataagtttatgagcttttataaggataacctagaaaatatagtagatgctatcattactctaaaatatataatgaataatccagattttaaaactacgtatgcagaagtactcggttccagaatagcggatatagatattaaacaagtgatacgtgagaatatactacaattgtctaataatatccgcgaacgatatttgtga

SEQ ID NO: 366 - protein, 162 aa, vaccinia virus
MDEAYYSGNLESVLGYVSDMHTELASISQLVIAKIETIDNDILNKDIVNFIMCRSNLDNPFISFLDTVYTIIDQEIYQTELINSLDDNEIIDCIVNKFMSFYKDNLENIVDAIITLKYIMNNPDFKTTYAEVLGSRIADIDIKQVIRENILQLSNNIRERYL

SEQ ID NO: 367 - DNA, 1659 bp, vaccinia virus
  CDS (1)...(1659)
atgacgtcttttcgtgaatttagaaaattatgctgtgctatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattagtacattcttcaaagaaaacacagaaatccgtccaagagataaaagcattttaactttagaagacgtggatagtttcttaactacgttatcatccgtaactaaagaattgcatcaaataaaattattgactgatgtagcatctgtttgtacatgtaatgatttaaaatgtgtagtcatgcttattgataaagatctaaaaattaaagcgggccctcggtacgtacttaacgctattagtcctcatgcctatgatgtttttagaaaatctaataacttgaaagagataatagaaaatgcatctaaacaaaatctagactctatatctatttctgttatgactccaattaatcccatgttagcggaatcgtgtgattctgtcaataaggcgtttaaaaaatttccatcaggaatgtttgcggaagttaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggtatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcttactatggtaaaggagcaaagggtggtatcatggcagtctttctaatgggttgttacgacgataaatccggtaaatggaagacggttaccaagtgttcaggacacgatgataatacgttaagggagttgcaagaccaattaaagatgattaaaattaacaaggatcccaaaaaaattccagagtggttggtagttaataaaatctatattcccgattttgtagtagaggatccaaaacaatctcagatatgggaaatttcaggagcagagtttacatcttccaagtcacatacagcgaatggaatatcgattagatttcctagatttactaggataagagaggataaaacgtggaaagaatctactcatctaaacgatttagtaaacttgactaaatcttaa

SEQ ID NO: 368 - protein, 552 aa, vaccinia virus
MTSFREFRKLCCAIYHASGYKEKSKLIRDFITDRDDKYLIIKLLLPGLDDRIYNMNDKQIIKLYSIIFKQSQEDMLQDLGYGYIGDTISTFFKENTEIRPRDKSILTLEDVDSFLTTLSSVTKELHQIKLLTDVASVCTCNDLKCVVMLIDKDLKIKAGPRYVLNAISPHAYDVFRKSNNLKEIIENASKQNLDSISISVMTPINPMLAESCDSVNKAFKKFPSGMFAEVKYDGERVQVHKNNNEFAFFSRNMKPVLSHKVDYLKEYIPKAFKKATSIVLDSEIVLVDEHNVPLPFGSLGIHKKKEYKNSNMCLFVFDCLYFDGFDMTDIPLYERRSFLKDVMVEIPNRIVFSELTNISNESQLTDVLDDALTRKLEGLVLKDINGVYEPGKRRWLKIKRDYLNEGSMADSADLVVLGAYYGKGAKGGIMAVFLMGCYDDKSGKWKTVTKCSGHDDNTLRELQDQLKMIKINKDPKKIPEWLVVNKIYIPDFVVEDPKQSQIWEISGAEFTSSKSHTANGISIRFPRFTRIREDKTWKESTHLNDLVNLTKS

SEQ ID NO: 369 - DNA, 210 bp, vaccinia virus
  CDS (1)...(210)
atggatggtgttattgtatactgtctaaacgcgttagtaaaacatggcgaggaaataaatcatataaaaaatgatttcatgattaaaccatgttgtgaaaaagttaagaacgttcacatcgacggacaatctaaaaacaatacagtgattgcagatttgccatatctggataatgctgtatcggatgtatgcaaatcgatatatatatag

SEQ ID NO: 370 - protein, 69 aa, vaccinia virus
MDGVIVYCLNALVKHGEEINHIKNDFMIKPCCEKVKNVHIDGQSKNNTVIADLPYLDNAVSDVCKSIYI

SEQ ID NO: 371 - DNA, 801 bp, vaccinia virus
  CDS (1)...(801)
atgcaaatcgatatatatatagtatcaagaatatccagatttgctaatttgataaagatagatgacgatgacaagactcctactggtgtatataattattttaaacctaaagatgccattcctgttattatatccataggaaaggatagagatgtttgtgaactattaatctcatctgataaagcgtgtgcgtgtatagagttaaattcatataaagtagccattcttcccatggatgtttccttttttaccaaaggaaatgcatcattgattattctcctgtttgatttctctatcgatgcggcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcgatagctgataatagaacttacgcaaatattagcaaaaatatattagacaatactacaattaacgatgagtgtagatgctgttattttgaaccacagattaggattcttgatagagatgagatgctcaatggatcatcgtgtgatatgaacagacattgtattatgatgaatttacctgatgtaggcaaatttggatctagtatgttggggaaatatgaacctgacatgattaagattgctcttttggtggctggtaatttaataagaaatcgagactacattcccgggagacgaggatatagctactacgtttacggtatagcctctagataa

SEQ ID NO: 372 - protein, 266 aa, vaccinia virus
MQIDIYIVSRISRFANLIKIDDDDKTPTGVYNYFKPKDAIPVIISIGKDRDVCELLISSDKACACIELNSYKVAILPMDVSFFTKGNASLIILLFDFSIDAAPLLRSVTDNNVIISRHQRLHDELPSSNWFKFYISIKSDYCSILYMVVDGSVMHAIADNRTYANISKNILDNTTINDECRCCYFEPQIRILDRDEMLNGSSCDMNRHCIMMNLPDVGKFGSSMLGKYEPDMIKIALLVAGNLIRNRDYIPGRRGYSYYVYGIASR

SEQ ID NO: 373 - DNA, 573 bp, vaccinia virus
  CDS (1)...(573)
atggacataaagatagatattagtatttttggtgataaatttacggtgactactaggagggaaaatgaagaaaaaaaaaaatatctacctctccaaaaagaaaaaactactgatgttatcaaacctgattatcttgagtacgatgacttgttagatagagatgagatgtttactattctagaggaatattttatgtacagaggtctattaggcctcagaataaaatatggacgactctttaacgaaattaaaaaattcgacaatgatgcggaagaacaattcggtactatagaagaactcaagcagaaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagcgattaaactgtttattaatgatcacatgcttgataagataaaatctatactgcagaatagactagtgtatgtggaaatgtcatag

SEQ ID NO: 374 - protein, 190 aa, vaccinia virus
MDIKIDISIFGDKFTVTTRRENEEKKKYLPLQKEKTTDVIKPDYLEYDDLLDRDEMFTILEEYFMYRGLLGLRIKYGRLFNEIKKFDNDAEEQFGTIEELKQKLRLNSEEGADNFIDYIKVQKQDIVKLTVYDCISMIGLCACVVDVWRNEKLFSRWKYCLRAIKLFINDHMLDKIKSILQNRLVYVEMS

SEQ ID NO: 375 - DNA, 111 bp, vaccinia virus
  CDS (1)...(111)
atgtttaaagttatcagattaaaatatattttcgaaattaatagctgtatatctcatccatcaattttagatttatatgttttgaaaaacactatcttactcatactctag

SEQ ID NO: 376 - protein, 36 aa, vaccinia virus
MFKVIRLKYIFEINSCISHPSILDLYVLKNTILLIL

SEQ ID NO: 377 - DNA, 399 bp, vaccinia virus
  CDS (1)...(399)
atggatataaagaatttgctgactgtatgtactattttttacattactacattggctacggcagatatacctacttcgtcactgccacacgctccggtaaacggggcatgtgacgagggagaatatcttgataagaggcataatcaatgttgtaatcagtgtccacctggagaatttgccaaggtcagatgtagtggtagtgataacacaaaatgtgaacgctgcccacctcatacatataccgcaatccccaattactctaatggatgtcatcaatgtagaaaatgcccaacaggatcatttgataaggtaaagtgtaccggaacacagaacagtaaatgttcgtgtcttcctggttggtattgcgctactgattcttcacagactgaagattgttga

SEQ ID NO: 378 - protein, 132 aa, vaccinia virus
MDIKNLLTVCTIFYITTLATADIPTSSLPHAPVNGACDEGEYLDKRHNQCCNQCPPGEFAKVRCSGSDNTKCERCPPHTYTAIPNYSNGCHQCRKCPTGSFDKVKCTGTQNSKCSCLPGWYCATDSSQTEDC

SEQ ID NO: 379 - DNA, 1695 bp, vaccinia virus
  CDS (1)...(1695)
atgaatagcagcagtaaattaattgctgttattaatggatttagaaatagtggacgattttgtgatattaatatagttattaatgatgaaaggataaacgctcataaactcatcctatctggagcctccgaatatttttccattctgttttccaataattttatcgattctaatgaatacgaagttaatctaagtcatttagattatcaaagcgtaaacgatttgatcgattatatttatgggatacctttgagcctaactaacgataacgtgaaatatattctttcaaccgctgattttttacaaattggatctgctattacggagtgtgaaaattacatacttaaaaatctttgttctaaaaactgtatcgatttctacatatacgctgataaatataataacaagaaaatagaatcagcgtcgtttaacacaatattacaaaatattttgagactcatcaacgatgaaaactttaaatacttaacagaggaatcaatgataaaaattttaagcgatgatatgttaaatataaaaaatgaggatttcgccccactaattctcattaaatggttagagagtactcaacaatcatgcaccgtcgagttacttaaatgcctcagaatatcattgctttccccacaagttataaaatcactttatagtcatcaactggttagttcaatctacgaatgtataacattcttaaacaatatagcattcttggatgaatcatttcctagataccatagcatcgagttgatatctatcggtataagtaattcgcgtgataaaatttccataaactgctacaatcataaaaaaaatacatgggaaatgatatcttcacgtagatataggtgtagtttcgcagtggccgtcctggataatattatctatatgatgggtggatatgatcagtccccgtatagaagttcaaaggttatagcgtacaatacatgtacaaattcttggatatatgatataccagagctaaaatatcctcgttctaattgtgggggactggctgatgacgaatacatttattgtataggcggcatacgcgatcaggattcatcgttgacatctagtattgatagatggaagccatcaaaaccatattggcagaagtatgctaaaatgcgcgaaccaaaatgtgatatgggggttgcgatgttaaacggattaatatatgtcatgggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatctagtccttagctataattcgatatatgatgaatggaccaaattatcatcattaaatattcctagaattaatcccgctctatggtcagcgcataataaattatatgtaggaggaggaatatctgatgatgttcaaactaatacatctgaaacatacgataaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttga

SEQ ID NO: 380 - protein, 564 aa, vaccinia virus
MNSSSKLIAVINGFRNSGRFCDINIVINDERINAHKLILSGASEYFSILFSNNFIDSNEYEVNLSHLDYQSVNDLIDYIYGIPLSLTNDNVKYILSTADFLQIGSAITECENYILKNLCSKNCIDFYIYADKYNNKKIESASFNTILQNILRLINDENFKYLTEESMIKILSDDMLNIKNEDFAPLILIKWLESTQQSCTVELLKCLRISLLSPQVIKSLYSHQLVSSIYECITFLNNIAFLDESFPRYHSIELISIGISNSRDKISINCYNHKKNTWEMISSRRYRCSFAVAVLDNIIYMMGGYDQSPYRSSKVIAYNTCTNSWIYDIPELKYPRSNCGGLADDEYIYCIGGIRDQDSSLTSSIDRWKPSKPYWQKYAKMREPKCDMGVAMLNGLIYVMGGIVKGDTCTDALESLSEDGWMKHQRLPIKMSNMSTIVHDGKIYISGGYNNSSVVNVISNLVLSYNSIYDEWTKLSSLNIPRINPALWSAHNKLYVGGGISDDVQTNTSETYDKEKDCWTLDNGHVLPRNYIMYKCEPIKHKYPLEKTQYTNDFLKYLESFIGS

SEQ ID NO: 381 - DNA, 930 bp, vaccinia virus
  CDS (1)...(930)
atgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattctattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcaactacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatcgcgactccggaaccaattactgataatgtagaagatcatacagacaccgtcacatacactagtgatagcattaatacagtaagtgcaacatctggagaatccacaacagacgagactccggaaccaattactgataaagaagatcatacagttacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctag

SEQ ID NO: 382 - protein, 309 aa, vaccinia virus
MTRLPILLLLISLVYATPFPQTSKKIGDDATLSCNRNNTNDYVVMSAWYKEPNSIILLAAKSDVLYFDNYTKDKISYDSPYDDLVTTITIKSLTARDAGTYVCAFFMTSTTNDTDKVDYEEYSTELIVNTDSESTIDIILSGSTHSPETSSEKPDYIDNSNCSSVFEIATPEPITDNVEDHTDTVTYTSDSINTVSATSGESTTDETPEPITDKEDHTVTDTVSYTTVSTSSGIVTTKSTTDDTYNDNDTVPPTTVGGSTTSISNYKTKDFVEIFGITALIILSAVAIFCITYYICNKRSRKYKTENKV

SEQ ID NO: 383 - DNA, 456 bp, vaccinia virus
  CDS (1)...(456)
atggaacgagaaggtgtcgattaccattacgttaacagagaggccatctggaagggaatagccgccggaaactttctagaacatactgagtttttaggaaatatttacggaacttctaaaacagctgtgaatacagcggctattaataatcgtatttgtgtgatggatctaaacatcgatggcgttagaagtcttaaaaatacgtacctaatgccttactcggtgtatataagacctacctctcttaaaatggttgagaccaagcttcgttgtagaaacactgaagctaacgatgagattcatcgtcgcgtgatattggcaaaaacggatatggatgaggccaacgaagcaggtctattcgacactattattattgaagatgatgtgaatttagcatatagtaagttaattcagatactacaggaccgtattagaatgtattttaacactaattaa

SEQ ID NO: 384 - protein, 151 aa, vaccinia virus
MEREGVDYHYVNREAIWKGIAAGNFLEHTEFLGNIYGTSKTAVNTAAINNRICVMDLNIDGVRSLKNTYLMPYSVYIRPTSLKMVETKLRCRNTEANDEIHRRVILAKTDMDEANEAGLFDTIIIEDDVNLAYSKLIQILQDRIRMYFNTN

SEQ ID NO: 385 - DNA, 903 bp, vaccinia virus
  CDS (1)...(903)
atgaactttcaaggacttgtgttaactgacaattgcaaaaatcaatgggtcgttggaccattaataggaaaaggtggatttggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagattaccaaaaaggtcggtgatgttgatcggaatcgaaatcttaaataccatacaatttatgcacgagcaaggatattctcacggagatattaaagcgagtaatatagtcttagatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttgccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattacgacgagtttcggcacatattaatgcagggtgtatattattaa

SEQ ID NO: 386 - protein, 300 aa, vaccinia virus
MNFQGLVLTDNCKNQWVVGPLIGKGGFGSIYTTNDNNYVVKIEPKANGSLFTEQAFYTRVLKPSVIEEWKKSHNIKHVGLITCKAFGLYKSINVEYRFLVINRLGADLDAVIRANNNRLPKRSVMLIGIEILNTIQFMHEQGYSHGDIKASNIVLDQIDKNKLYLVDYGLVSKFMSNGEHVPFIRNPNKMDNGTLEFTPIDSHKGYVVSRRGDLETLGYCMIRWLGGILPWTKISETKNCALVSATKQKYVNNTATLLMTSLQYAPRELLQYITMVNSLTYFEEPNYDEFRHILMQGVYY

SEQ ID NO: 387 - DNA, 660 bp, vaccinia virus
  CDS (1)...(660)
atggcgatgttttacgcacacgctctcggtgggtacgacgagaatcttcatgcctttcctggaatatcatcgactgttgccaatgatgtcaggaaatattctgttgtgtcagtttataataacaagtatgacattgtaaaagacaaatatatgtggtgttacagtcaggtgaacaagagatatattggagcactgctgcctatgtttgagtgcaatgaatatctacaaattggagatccgatccatgatcaagaaggaaatcaaatctctatcatcacatatcgccacaaaaactactatgctctaagcggaatcgggtacgagagtctagacttgtgtttggaaggagtagggattcatcatcacgtacttgaagcaggaaacgctgtatatggaaaagttcaacatgattattctactatcaaagagaaggccaaagaaatgagtacacttagtccaggacctataattgattaccacgtctggataggagattgtatctgtcaagttactgctgtggacgtacatggaaaggaaattatgaaaatgagattcaaaaagggtgcggtgcttccgatcccaaatctggtaaaagttaaacttggggagaatgatacagaaaatctttcttctactatatcggcggcaccatcgaggtaa

SEQ ID NO: 388 - protein, 219 aa, vaccinia virus
MAMFYAHALGGYDENLHAFPGISSTVANDVRKYSVVSVYNNKYDIVKDKYMWCYSQVNKRYIGALLPMFECNEYLQIGDPIHDQEGNQISIITYRHKNYYALSGIGYESLDLCLEGVGIHHHVLEAGNAVYGKVQHDYSTIKEKAKEMSTLSPGPIIDYHVWIGDCICQVTAVDVHGKEIMKMRFKKGAVLPIPNLVKVKLGENDTENLSSTISAAPSR

SEQ ID NO: 389 - DNA, 375 bp, vaccinia virus
  CDS (1)...(375)
atgaaacgtttggaaactatacgccatatgtggtctgttgtatatgatcattttaatattgtgaatggtaaagaatgctgttatgtgcatacgcatttgtctaatcaaaatcttataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaatcaattgagagattggcagaggagttcttcaatagatcagaacttcaggctggtaaatcagttaaatttggtaattctattaattgttaa

SEQ ID NO: 390 - protein, 124 aa, vaccinia virus
MKRLETIRHMWSVVYDHFNIVNGKECCYVHTHLSNQNLIPSTVKTNLYMKTMGSCIQMDSMEALEYLSELKESGGWSPRPEMQEFEYPDGVEDTESIERLAEEFFNRSELQAGKSVKFGNSINC

SEQ ID NO: 391 - DNA, 1677 bp, vaccinia virus
  CDS (1)...(1677)
atggatttttttaaaaaggaaatacttgactggagtatatatttatctcttcattatatagcacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcgggttatcatcatccattaatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgccgaagacagttacggttgtacattattacatagatgtatatatcactataagaaatcagaatcagaatcatacaatgaattaattaagatattgttaaataatggatccgatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacagaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaacataaacagcataatgcagatttattgaaaatgtgtataaaatatactgcgtgtatgaccgattatgatactcttatagatgtacagtcgctacagcaatataaatggtatattttaagatgtttcgatgaaatagatatcatgaagagatgttatataaaaaataaaactgtattccaattagttttttgtatcaaagacattaatactttaatgagatacggtaaacatccttctttcgtgaaatgcactagtctcgacgtatacggaagtcgtgtacgtaatatcatagcatctattagatatcgtcagagattaattagtctattatccaagaagctggatgcgggagataaatggtcgtgttttcctaacgaaataaaatataaaatattggaaaactttaacgataacgaactgtccacatatctaaaaatcttataa

SEQ ID NO: 392 - protein, 558 aa, vaccinia virus
MDFFKKEILDWSIYLSLHYIARVFSNFSTSHIIQDYNLVRTYEKVDKTIVDFLSRLPNLFHILEYGENILHIYSMDDANTNIIIFFLDRVLNINKNGSFIHNLGLSSSINIKEYVYQLVNNDHPDNRIRLMLENGRRTRHFLSYISDTVNIYICILINHGFYIDAEDSYGCTLLHRCIYHYKKSESESYNELIKILLNNGSDVDKKDTYGNTPFILLCKHDINNVELFEICLENANIDSVDFNRYTPLHYVSCRNKYDFVKLLISKGANVNARNKFGTTPFYCGIIHGISLIKLYLESDTELEIDNEHIVRHLIIFDAVESLDYLLSRGVIDINYRTIYNETSIYDAVSYNAYNTLVYLLNRNGDFETITTSGCTCISEAVANNNKIIMEVLLSKRPSLKIMIQSMIAITKHKQHNADLLKMCIKYTACMTDYDTLIDVQSLQQYKWYILRCFDEIDIMKRCYIKNKTVFQLVFCIKDINTLMRYGKHPSFVKCTSLDVYGSRVRNIIASIRYRQRLISLLSKKLDAGDKWSCFPNEIKYKILENFNDNELSTYLKIL

SEQ ID NO: 393 - DNA, 954 bp, vaccinia virus
  CDS (1)...(954)
atgaaaacgatttccgttgttacgttgttatgcgtactacctgctgttgtttattcaacatgtactgtacccactatgaataacgctaaattaacgtctaccgaaacatcgtttaataataaccagaaagttacatttacatgtgatcagggatatcattctttggatccaaatgctgtctgcgaaacagataaatggaaatacgaaaatccatgcaagaaaatgtgcacagtttctgattatgtctctgaactatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatataactatcaactgtgatgttggatatgaggttattggtgcttcgtacataagttgtacagctaattcttggaatgttattccatcatgtcaacaaaaatgtgatataccgtctctatctaatggattaatttccggatctacattttctatcggtggcgttatacatcttagttgtaaaagtggttttatactaacgggatctccatcatccacatgtatcgacggtaaatggaatcccatactcccaacatgtgtacgatctaacgaaaaatttgatccagtggatgatggtcccgacgatgagacagatttgagcaaactctcgaaagacgttgtacaatatgaacaagaaatagaatcgttagaagcaacttatcatataatcatagtggcgttaacaattatgggcgtcatatttttaatctccgttatagtattagtttgttcctgtgacaaaaataatgaccaatataagttccataaattgctaccgtaa

SEQ ID NO: 394 - protein, 317 aa, vaccinia virus
MKTISVVTLLCVLPAVVYSTCTVPTMNNAKLTSTETSFNNNQKVTFTCDQGYHSLDPNAVCETDKWKYENPCKKMCTVSDYVSELYNKPLYEVNSTMTLSCNGETKYFRCEEKNGNTSWNDTVTCPNAECQPLQLEHGSCQPVKEKYSFGEYITINCDVGYEVIGASYISCTANSWNVIPSCQQKCDIPSLSNGLISGSTFSIGGVIHLSCKSGFILTGSPSSTCIDGKWNPILPTCVRSNEKFDPVDDGPDDETDLSKLSKDVVQYEQEIESLEATYHIIIVALTIMGVIFLISVIVLVCSCDKNNDQYKFHKLLP

SEQ ID NO: 395 - DNA, 519 bp, vaccinia virus
  CDS (1)...(519)
atgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatattactgtatgtgtgggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaa

SEQ ID NO: 396 - protein, 173 aa, vaccinia virus
MSSSVDVDIYDAVRAFLLRHYYNKRFIVYGRSNAILHNIYRLFTRCAVIPFDDIVRTMPNESRVKQWVMDTLNGIMMNERDITVCVGTGILFMEMFFDYNKNSINNQLMYDIINSVSIILANERYRSAFNDDGIYIRRNMINKLYGYASLTTIGTIAGGVCYYLLMHLVSLYK

SEQ ID NO: 397 - DNA, 549 bp, vaccinia virus
  CDS (1)...(549)
atgtataaaaaactaataacgtttttatttgtaataggtgcagtagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaa

SEQ ID NO: 398 - protein, 182 aa, vaccinia virus
MYKKLITFLFVIGAVASYSNNEYTPFNKLSVKLYIDGVDNIENSYTDDNNELVLNFKEYTISIITESCDVGFDSIDIDVINDYKIIDMYTIDSSTIQRRGHTCRISTKLSCHYDKYPYIHKYDGDERQYSITAEGKCYKGIKYEISMINDDTLLRKHTLKIGSTYIFDRHGHSNTYYSKYDF

SEQ ID NO: 399 - DNA, 816 bp, vaccinia virus
  CDS (1)...(816)
atgagatatattataattctcgcagttttgttcattaatagtatacatgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattaactgaatacgacgaccatatcaatttgtacatcgagcatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcggaagtatgtctgacacctaaaaagagtgtatatacatgcgcaattagatccaaagaagatgttcccaatttcaaggacaaaatggccagagttatcaagagaaaatttaataaacagtctcaatcttatttaactaaatttctcggtagcacatcaaatgatgttaccacttttcttagcatgcttaacttgactaaatattca

SEQ ID NO: 400 - protein, 272 aa, vaccinia virus
MRYIIILAVLFINSIHAKITSYKFESVNFDSKIEWTGDGLYNISLKNYGIKTWQTMYTNVPEGTYDISAFPKNDFVSFWVKFEQGDYKVEEYCTGLCVEVKIGPPTVTLTEYDDHINLYIEHPYATRGSKKIPIYKRGDMCDIYLLYTANFTFGDSKEPVPYDIDDYDCTSTGCSIDFVTTEKVCVTAQGATEGFLEKITPWSSEVCLTPKKSVYTCAIRSKEDVPNFKDKMARVIKRKFNKQSQSYLTKFLGSTSNDVTTFLSMLNLTKYS

SEQ ID NO: 401 - DNA, 234 bp, vaccinia virus
  CDS (1)...(234)
atgaggtccctgattatagtccttctgttcccctctatcatctactccatgtctattagacgatgtgagaagactgaagaggaaacatggggattgaaaatagggttgtgtataattgccaaagatttttatcccgaaagaactgattgcagtgttcatctcccaactgcaagtgaaggattgataactgaaggcaatggattcagggatatacgaaacaccgataaattataa

SEQ ID NO: 402 - protein, 77 aa, vaccinia virus
MRSLIIVLLFPSIIYSMSIRRCEKTEEETWGLKIGLCIIAKDFYPERTDCSVHLPTASEGLITEGNGFRDIRNTDKL

SEQ ID NO: 403 - DNA, 501 bp, vaccinia virus
  CDS (1)...(501)
atggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcatcgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattga

SEQ ID NO: 404 - protein, 166 aa, vaccinia virus
MDSGIYETPINYKKSNVSAVSVNNTIFVTGGLFINNSNSTIVVNNMEKLDIYKDKQWSIIEMPMARVYHGIDSTFGMLYFAGGLSVTEQYGNLEKNNEISCYNPRTNKWFDISYTIYKISISSLCKLNNVFYVFSKDIGYVEKYDGAWKLVHDRLPAIKALSTSPY

SEQ ID NO: 405 - DNA, 219 bp, vaccinia virus
  CDS (1)...(219)
atggatacagatgttacaaatgtagaagatatcataaatgaaatagatagagagaaagaagaaatactaaaaaatgtagaaattgaaaataataaaaacattaacaagaatcatcccaatgaatatattagagaagcactcgttattaataccagtagtaatagtgattccattgataaagaagttatagaatgtatctgtcacgatgtaggaatatag

SEQ ID NO: 406 - protein, 72 aa, vaccinia virus
MDTDVTNVEDIINEIDREKEEILKNVEIENNKNINKNHPNEYIREALVINTSSNSDSIDKEVIECICHDVGI

SEQ ID NO: 407 - DNA, 852 bp, vaccinia virus
  CDS (1)...(852)
atggaatccttcaagtattgttttgataacgatggcaagaaatggattatcggaaatactttatattctggtaattcaatactatataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaaaaattcgggaagagtattcgccccaaaggatactgaatcagtcttcgaagcatgtgtcactatgataaacacgttagagtttatacactctcgaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaaaacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtaaactgtttatacaagattga

SEQ ID NO: 408 - protein, 283 aa, vaccinia virus
MESFKYCFDNDGKKWIIGNTLYSGNSILYKVRKNFTSSFYNYVMKIDHKSHKPLLSEIRFYISVLDPLTIDNWTRERGIKYLAIPDLYGIGETDDYMFFVIKNSGRVFAPKDTESVFEACVTMINTLEFIHSRGFTHGKIEPRNILIRNKRLSLIDYSRTNKLYKSGNSHIDYNEDMITSGNINYMCVDNHLGATVSKRGDLEMLGYCMIEWFGGKLPWKNESSIKVIKQKKEYKKFIATFFEDCFPEGNEPLELVRYIELVYTLDYSQTPNYDRLRKLFIQD

SEQ ID NO: 409 - DNA, 381 bp, vaccinia virus
  CDS (1)...(381)
atggatatcttcagggaaatcgcatcttctatgaaaggagagaatgtatttatttctccagcgtcaatctcgtcagtattgacaatactgtattatggagctaatggatccactgctgaacagctatcaaaatatgtagaaacggaggagaacacggataaggttagcgctcagaatatctcattcaaatccatgaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaaccattgtctcctagcaattag

SEQ ID NO: 410 - protein, 126 aa, vaccinia virus
MDIFREIASSMKGENVFISPASISSVLTILYYGANGSTAEQLSKYVETEENTDKVSAQNISFKSMNKVYGRYSAVFKDSFLRKIGDKFQTVDFTDCRTIDAINKCVDIFTEGKINPLLDEPLSPSN

SEQ ID NO: 411 - DNA, 669 bp, vaccinia virus
  CDS (1)...(669)
atgaaccattgtctcctagcaattagtgccgtatactttaaagcaaaatggttgacgccattcgaaaaggaatttaccagtgattatcccttttacgtatctccgacggaaatggtagatgtaagtatgatgtctatgtacggcaaggcatttaatcacgcatctgtaaaggaatcattcggcaacttttcaatcatagaactgccatatgttggagatactagtatgatggtcattcttccagacaagattgatggattagaatccatagaacaaaatctaacagatacaaattttaagaaatggtgtgactttatggatgctatgtttatagatgttcacattcccaagtttaaggtaacaggctcgtataatctggtggatactctagtaaagtcaggactgacagaggtgttcggttcaactggagattatagcaatatgtgtaattcagatgtgagtgtcgacgctatgatccacaaaacgtatatagatgtcaatgaagagtatacagaagcagctgcagcaacttgtgcactggtgtcagactgtgcatcaacaattacaaatgagttctgtgtagatcatccgttcatctatgtgattaggcatgttgatggcaaaattcttttcgttggtagatattgctctccaacaactaattgttaa

SEQ ID NO: 412 - protein, 222 aa, vaccinia virus
MNHCLLAISAVYFKAKWLTPFEKEFTSDYPFYVSPTEMVDVSMMSMYGKAFNHASVKESFGNFSIIELPYVGDTSMMVILPDKIDGLESIEQNLTDTNFKKWCDFMDAMFIDVHIPKFKVTGSYNLVDTLVKSGLTEVFGSTGDYSNMCNSDVSVDAMIHKTYIDVNEEYTEAAAATCALVSDCASTITNEFCVDHPFIYVIRHVDGKILFVGRYCSPTTNC

SEQ ID NO: 413 - DNA, 450 bp, vaccinia virus
  CDS (1)...(450)
atgacggccaactttagtacccacgtcttttcaccacagcactgtggatgtgacagactgaccagtattgatgacgtcaaacaatgtttgactgaatatatttattggtcgtcctatgcataccgcaacaggcaatgcgctggacagttgtattccacactcctctcttttagagatgatgcggaattagtgttcatcgacattcgcgagctggtaaaacatatgccgtgggatgatgtcaaagattgtgcagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctaaattacgtggattataacatcatattccggcgtatgaattga

SEQ ID NO: 414 - protein, 149 aa, vaccinia virus
MTANFSTHVFSPQHCGCDRLTSIDDVKQCLTEYIYWSSYAYRNRQCAGQLYSTLLSFRDDAELVFIDIRELVKHMPWDDVKDCAEIIRCYIPDEQKTIREISAIIGLCAYAATYWGGEDHPTSNSLNALFVMLEMLNYVDYNIIFRRMN

SEQ ID NO: 415 - DNA, 981 bp, vaccinia virus
  CDS (1)...(981)
atgagtatactacctattatatttctttctatatttttttattcttcattcgttcagacttttaacgcgtctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagatcttatctcgtatccacaaatagtaaatgagagatctactggcgaaatggtatgtcccaatattaatgcatttattgctagtaacgtaaacgcagatattatatggagcggacatcgacgccttagaaataagagacttaaacaacggacacctggaattattaccatagaagatgttagaaaaaatgatgctggttattatacatgtgttttagaatatatatacggtggcaaaacatataacgtaaccagaattgtaaaattagaggtacgggataaaataataccttctactatgcaattaccagatggcattgtaacttcaataggtagtaatttgactattgcgtgtagagtatcgttgagacctcccacaacggacaccgacgtcttttggataagtaatggtatgtattacgaagaagatgatggggacggaaacggtagaataagtgtagcaaataaaatctatatgaccgataagagacgtgttattacatcccggttaaacattaatcctgttaaggaagaagatgctacaacgtttacgtgtatggcgtttactattcctagcatcagtaaaacagttactgttagtataacgtga

SEQ ID NO: 416 - protein, 326 aa, vaccinia virus
MSILPIIFLSIFFYSSFVQTFNASECIDKGQYFASFMELENEPVILPCPQINTLSSGYNILDILWEKRGADNDRIIPIDNGSNMLILNPTQSDSGIYICITTNETYCDMMSLNLTIVSVSESNIDLISYPQIVNERSTGEMVCPNINAFIASNVNADIIWSGHRRLRNKRLKQRTPGIITIEDVRKNDAGYYTCVLEYIYGGKTYNVTRIVKLEVRDKIIPSTMQLPDGIVTSIGSNLTIACRVSLRPPTTDTDVFWISNGMYYEEDDGDGNGRISVANKIYMTDKRRVITSRLNINPVKEEDATTFTCMAFTIPSISKTVTVSIT

SEQ ID NO: 417 - DNA, 1020 bp, vaccinia virus
  CDS (1)...(1020)
atgtctagaaagtttatgcaggtgtatgaatatgacagagagcaatatctcgatgagttcatcgaagacagatataacgatagttttatcactagtccagaatactatagtgcggaaaaatacatgtgtagatatactacactaaatcacaattgtataaacgtacgacgatgcgcgttagactccaagttattacatgatatcataaccaattgtaaaatatataacaatatagaattagttagggcgacaaaatttgtttattatctggatctgataaaatgtaattgggtatctaaggtaggtgattcagttctatatcccgttatatttataacacatacaagcactagaaatttagataaagtctctgtaaaaacatacaagggcgttaaagtaaaaaaacttaatagatgcgcggatcatgctattgtaattaatccattcgtcaagtttaaactaacgttgccgaacaaaacaagtcatgcaaaggtattggttacattttgtaagttaagaacggatataacgcagatagaggcaccgcttccgggcaatgttttagtttatacatttcccgatattaataaacgaattcctggatatatacatgtcaacatagaaggatgtatcgatggaatgatttatataaattcttcaaagttcgcgtgtgttttaaaactacatagatcaatgtatcgcattccaccctttcctatagatatctgctcttgttgttcacaatatactaacgatgacatagaaattcccattcatgatttaataaaggatgtggcaatttttaaaaataaggagacggtatattatctaaaattaaataataaaactatagctagatttacgtactttaataatatagatactgcaattacacaagaacacgagtatgtcaaaatagctctaggtatagtctgcaagttaatgattaataatatgcatagtatcgtgggagttaatcatagcaatacgttcgtcaattgcttgttggaagataatgta

SEQ ID NO: 418 - protein, 340 aa, vaccinia virus
MSRKFMQVYEYDREQYLDEFIEDRYNDSFITSPEYYSAEKYMCRYTTLNHNCINVRRCALDSKLLHDIITNCKIYNNIELVRATKFVYYLDLIKCNWVSKVGDSVLYPVIFITHTSTRNLDKVSVKTYKGVKVKKLNRCADHAIVINPFVKFKLTLPNKTSHAKVLVTFCKLRTDITQIEAPLPGNVLVYTFPDINKRIPGYIHVNIEGCIDGMIYINSSKFACVLKLHRSMYRIPPFPIDICSCCSQYTNDDIEIPIHDLIKDVAIFKNKETVYYLKLNNKTIARFTYFNNIDTAITQEHEYVKIALGIVCKLMINNMHSIVGVNHSNTFVNCLLEDNV

SEQ ID NO: 419 - DNA, 1725 bp, vaccinia virus
  CDS (1)...(1725)
atgagtcgtcgtctgatttatgttttaaatatcaaccgcgaatcaactcataaaatacaagagaatgaaatatatacatattttagtcattgcaatatagaccatacttctacagaacttgattttgtagttaaaaactatgatctaaacagacgacaacctgtaactgggtatactgcactacactgctatttgtataataattactttacaaacgatgtactgaagatattattaaatcatggagtggatgtaacgatgaaaaccagtagcggacgtatgcctgtttatatattgcttactagatgttgtaatatttcacatgatgtagtgatagatatgatagacaaagataaaaaccacttatcgcatagagactattccaacctactactagagtatataaaatctcgttacatgttattgaaggaagaggatatcgatgagaacatagtatcaactttattagataagggaatcgatcctaactttaaacaagacggatatacagcgttacattattattatttgtgtctcgcacacgtttataaaccaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcaaaatatgtaataatcatggattaacgcctatactatgttatataacttccgactacatacaacacgatattcttgttatgttaatacatcactatgaaacaaatgttggagaaatgccgatagatgagcgtcgtataatcgtattcgagtttatcaaaacatattctacacgtccggcagattcgataacttatttgatgaataggtttaaaaatataaatatttatacccgctatgaaggaaagacattattacacgtagcatgtgaatataataatacacaagtaatagattatcttatacgtatcaacggagatataaatgcgttaaccgacaataacaaacacgctatccaactcattatagataacaaagaaaattccccgtataccatcgattgtttattgtatatacttagatatattgtagataagaatgtgataagatcgttggtggatcaacttccatctctacctatcttcaatataaaatcatttgagaaattcatatcctactgtatacttttagatgacacattttacaataggcacgttaggaatcgcaattctaaaacgtatcgatacgcattttcaaaatacatgtcgtttgataaatacgatggtataataactaaatgtcataaagaaacaatattgctcaaactatccactgttctagacactacactatatgcagttttaagatgccataattcgaaaaagttaagaagatacctcaacgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatatcgtatccacctaccaaagtatag

SEQ ID NO: 420 - protein, 574 aa, vaccinia virus
MSRRLIYVLNINRESTHKIQENEIYTYFSHCNIDHTSTELDFVVKNYDLNRRQPVTGYTALHCYLYNNYFTNDVLKILLNHGVDVTMKTSSGRMPVYILLTRCCNISHDVVIDMIDKDKNHLSHRDYSNLLLEYIKSRYMLLKEEDIDENIVSTLLDKGIDPNFKQDGYTALHYYYLCLAHVYKPGECRKPITIKKAKRIISLFIQHGANLNALDNCGNTPFHLYLSIEMCNNIHMTKMLLTFNPNFKICNNHGLTPILCYITSDYIQHDILVMLIHHYETNVGEMPIDERRIIVFEFIKTYSTRPADSITYLMNRFKNINIYTRYEGKTLLHVACEYNNTQVIDYLIRINGDINALTDNNKHAIQLIIDNKENSPYTIDCLLYILRYIVDKNVIRSLVDQLPSLPIFNIKSFEKFISYCILLDDTFYNRHVRNRNSKTYRYAFSKYMSFDKYDGIITKCHKETILLKLSTVLDTTLYAVLRCHNSKKLRRYLNELKKYNNDKSFKIYSNIMNERYLNVYYKDMYVSKVYDKLFPVFTDKNCLLTLLPSEIIYEILYMLTINDLYNISYPPTKV

SEQ ID NO: 421 - DNA, 798 bp, vaccinia virus
  CDS (1)...(798)
atgacgatgaaaatgatggtacatatatatttcgtatcattatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatggccactctaggagagccattcagcgcaaagtgtcctcctattgaagacagtcttttatcgcacagatataaagactatgtggttaaatgggaaaggctagaaaagaatagacggcgacaggtttctaataaacgtgttaaacatggtgatttatggatagccaactatacatctaaattcagtaaccgtaggtatttgtgtaccgtaactacaaagaatggtgactgtgttcagggtatagttagatctcatattagaaaacctccttcatgcattccaaaaacatatgaactaggtactcatgataagtatggcatagacttatactgtggaattctttacgcaaaacattataataatataacttggtataaagataataaggaaattaatatcgacgatattaagtattcacaaacgggaaagaaattaattattcataatccagagttagaagatagcggaagatacgactgttacgttcattacgacgacgttagaatcaagaatgatatcgtagtatcaagatgtaaaatacttacggttataccgtcacaagaccacaggtttaaactaaaaagaaattgcggatatgcgtcaaattaa

SEQ ID NO: 422 - protein, 265 aa, vaccinia virus
MTMKMMVHIYFVSLSLLLLLFHSYAIDIENEITEFFNKMRDTLPAKDSKWLNPACMFGGTMNDMATLGEPFSAKCPPIEDSLLSHRYKDYVVKWERLEKNRRRQVSNKRVKHGDLWIANYTSKFSNRRYLCTVTTKNGDCVQGIVRSHIRKPPSCIPKTYELGTHDKYGIDLYCGILYAKHYNNITWYKDNKEINIDDIKYSQTGKKLIIHNPELEDSGRYDCYVHYDDVRIKNDIVVSRCKILTVIPSQDHRFKLKRNCGYASN

SEQ ID NO: 423 - DNA, 276 bp, vaccinia virus
  CDS (1)...(276)
atgcgtcaaattaaaataaatggtacggacatgcttacagtgatgtacatgttaaataaacctacaaagaaacgatatgttaataatccgatatttacagattgggctaataagcaatataagttttataatcaaataatatataatgctaataagttaatagaacaaagtaagaaaatagacgacatgatagaggaggtatccattgacgataatcgtttatcaacactaccgttagaaattagacatttgattttctcgtacgcgttcctataa

SEQ ID NO: 424 - protein, 91 aa, vaccinia virus
MRQIKINGTDMLTVMYMLNKPTKKRYVNNPIFTDWANKQYKFYNQIIYNANKLIEQSKKIDDMIEEVSIDDNRLSTLPLEIRHLIFSYAFL

SEQ ID NO: 425 - DNA, 168 bp, vaccinia virus
  CDS (1)...(168)
atgtcttctaaagggggtagtggcggcatgtggagtgtctttatccatggacatgatggtagtaataaaggatctaaaacttatacatctggtggcggtggaatgtggggaggaggatcgtccagtggggttaacggaggtgtaaaatctggaactggtaaaatttaa

SEQ ID NO: 426 - protein, 55 aa, vaccinia virus; identical to SEQ ID NO: 50

SEQ ID NO: 427 - DNA, 216 bp, vaccinia virus; identical to SEQ ID NO: 47
  CDS (1)...(216)

SEQ ID NO: 428 - protein, 71 aa, vaccinia virus; identical to SEQ ID NO: 48

SEQ ID NO: 429 - DNA, 234 bp, vaccinia virus; identical to SEQ ID NO: 45
  CDS (1)...(234)

SEQ ID NO: 430 - protein, 77 aa, vaccinia virus; identical to SEQ ID NO: 46

SEQ ID NO: 431 - DNA, 408 bp, vaccinia virus
  CDS (1)...(408)
atgaaaggaatagataacactgcttattcatatatagacgatctaacatgttgcactcgaggaattatggctgattatctaaatagtgattatagatacaataaagatgtagatttggtcaaattgtttttggagaatggaaagcctcacggaataatgtgtagtattgtaccactatggagaaatgataaggaaaccatctttttgatattgaaaacaatgaactcggatgtcctccaacatatactaattgagtatatgacattcggcgatatccctctagtggaatatggaactgtggtaaataaagaggctatacacggatactttagaaatattaatattgattcttacacgatgaaatatctactaaaaaaggaagggagatgccatcaattatctcgatga

SEQ ID NO: 432 - protein, 135 aa, vaccinia virus; identical to SEQ ID NO: 44

SEQ ID NO: 433 - DNA, 429 bp, vaccinia virus; identical to SEQ ID NO: 41
  CDS (1)...(429)

SEQ ID NO: 434 - protein, 142 aa, vaccinia virus; identical to SEQ ID NO: 42

SEQ ID NO: 435 - DNA, 273 bp, vaccinia virus; identical to SEQ ID NO: 39
  CDS (1)...(273)

SEQ ID NO: 436 - protein, 90 aa, vaccinia virus; identical to SEQ ID NO: 40

SEQ ID NO: 437 - DNA, 375 bp, vaccinia virus; identical to SEQ ID NO: 37
  CDS (1)...(375)

SEQ ID NO: 438 - protein, 124 aa, vaccinia virus; identical to SEQ ID NO: 38

SEQ ID NO: 439 - DNA, 186 bp, vaccinia virus
  CDS (1)...(186)
atgaagttgtttactcaaaacgatagatactttggtttattggattcgtgtaatcatatattttgcataacatgtatcaatatatggcataaaacacgaagagaaaccggtgcgtcggataattgtcctatatgtcgtacccgttttagaaacataacaatgagcaagttctataagctagttaac

SEQ ID NO: 440 - protein, 62 aa, vaccinia virus; identical to SEQ ID NO: 36

SEQ ID NO: 441 - DNA, 249 bp, vaccinia virus
  CDS (1)...(249)
atgcattatccgaaatattatatcaatatcacaaaaataaatccacatttggctaatcaatttcgggcttggaaaaaacgtatcgccggaagggactatatgactaacttatctagagatacaggaatacaacaatcaaaacttactgaaactatacgtaactgtcaaaaaaatagaaacatatatggtctatatatacactacaatttagttattaattggataaccgatgtgattatcaatcaatat

SEQ ID NO: 442 - protein, 83 aa, vaccinia virus; identical to SEQ ID NO: 34

SEQ ID NO: 443 - DNA, 996 bp, vaccinia virus; identical to SEQ ID NO: 31
  CDS (1)...(996)

SEQ ID NO: 444 - protein, 331 aa, vaccinia virus; identical to SEQ ID NO: 32

SEQ ID NO: 445 - DNA, 417 bp, vaccinia virus
  CDS (1)...(417)
atgtcgatgaaatatctgatgttgttgttcgctgctatgataatcagatcattcgccgatagtggtaacgctatcgaaacgacattgccagaaattacaaacgctacaacagatattccagctatcagattatgcggtccagagggagatggatattgtttacacggtgactgtatccacgctagagatatcgacggtatgtattgtagatgctctcatggttatacaggcattagatgtcagcatgtagtattagtagactatcaacgttcagaaaaaccaaacactacaacgtcatatatcccatctcccggtattatgcttgtattagtaggcattattattatgtgttgtctattatctgtttataggttcactcgacgaactaaactacctctacaagatatggttgtgcca

SEQ ID NO: 446 - protein, 139 aa, vaccinia virus; identical to SEQ ID NO: 30

SEQ ID NO: 447 - DNA, 1074 bp, vaccinia virus; identical to SEQ ID NO: 27
  CDS (1)...(1074)

SEQ ID NO: 448 - protein, 357 aa, vaccinia virus; identical to SEQ ID NO: 28

SEQ ID NO: 449 - DNA, 573 bp, vaccinia virus; identical to SEQ ID NO: 25
  CDS (1)...(573)

SEQ ID NO: 450 - protein, 190 aa, vaccinia virus; identical to SEQ ID NO: 26

SEQ ID NO: 451 - DNA, 156 bp, vaccinia virus; identical to SEQ ID NO: 23
  CDS (1)...(156)

SEQ ID NO: 452 - protein, 51 aa, vaccinia virus; identical to SEQ ID NO: 24

SEQ ID NO: 453 - DNA, 270 bp, vaccinia virus; identical to SEQ ID NO: 21
  CDS (1)...(270)

SEQ ID NO: 454 - protein, 89 aa, vaccinia virus; identical to SEQ ID NO: 22

SEQ ID NO: 455 - DNA, 546 bp, vaccinia virus; identical to SEQ ID NO: 19
  CDS (1)...(546)

SEQ ID NO: 456 - protein, 181 aa, vaccinia virus; identical to SEQ ID NO: 20

SEQ ID NO: 457 - DNA, 1149 bp, vaccinia virus
  CDS (1)...(1149)
atgattgccttcatcatttttcgtgaaataggaataattagcaccagaatagctatggattgcacatgtattctatgtcgtctactggatgaagatgtgacgtacaaaaaaataaaactagaaattgaaacgtgtcacaacttatcaaaacatatagatagacgaggaaacaatgcgctacattgttacgtcttcaataaatgcgatacagacattaagattgttcgactgttactctctcgcggagtcgagagactttgtagaaacaacgaaggattaactccgctaggagtatacagtaagcatagatacgtcaaatctcaaattgtgcatctactgatatccagctattcgaattcctctaacgaactcaagtcgaatataaatgatttcgatctgtattcggataatatcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacaacagtgatatgtgtaagaactctcttcattactatatatcgtctcatagagaatctcaatctctatccaaggatgtaattaaatgtttgatcaataacaatgtttccatccatggcagagacgaaggaggatctttacccatccaatactactggtctttctcaaccatagatatagagattgttaaattattattaataaaggatgtggacacgtgtagagtatacgacgtcagccctatattagaggcgtattatctaaacaagcgatttagagtaaccccatataatgtagacatggaaatcgttaatcttcttattgagagacgtcatactcttgtcgacgtaatgcgtagtattacttcgtacgattccagagaatataaccactacatcatcgataacattctaaagagatttagacaacaggatgaatccatcgtacaagccatgttgataaactacttacattacggcgatatggtcgttcgatgcatgttagataacggacaacaactatcctctgcacgactactttgttaa

SEQ ID NO: 458 - protein, 382 aa, vaccinia virus; identical to SEQ ID NO: 18

SEQ ID NO: 459 - DNA, 597 bp, vaccinia virus
  CDS (1)...(597)
atgtacggtctgatattatcgagatttaataattgcgggtatcactgttatgaaaccatactaatagatgtatttgatatactaagcaagtacatggataatatagatatgatcgataatgagaataaaactctactatattacgcggtcgatgtcaataatatacaatttgcaaagcggttattggaatatggagcgagtgttacaacatcacgctcgataatcaatacggccatccagaaaagtagttacagaagagaaaacaaaacgaagctagttgatttattacttagctaccatcccactctagagactatgattgacgcatttaatagagatatacgctatctatatcctgaaccattattcgcctgtatcagatacgccttaatcatagatgatgattttccttctaaagtaaagtatgatatcgccggtcgtcataaggaactaaagcgctatagagtagacattaatagaatgaagaatgcctacatatcaggcgtctccatgtttgatatattatttaaacgaagcaaacgccacagattgagatacgcaaagaatccgacatcaaatggtacaaaaaagaactaa

SEQ ID NO: 460 - protein, 198 aa, vaccinia virus; identical to SEQ ID NO: 16

SEQ ID NO: 461 - DNA, 414 bp, vaccinia virus
  CDS (1)...(414)
atgtctcgcataaacattactaaaaaaatatattgttcggttttctttcacatctttaattatgaaaaagtaaatcattatgagatggacgagattgtacgcatcgttcgcgacagtatgtggtacatacctaacgtatttatggacgacggtaagaatgaaggtcacgtttctgtcaacaatgtttgtcatatgtattttacgttctttgatgtggatacatcgtctcatctgtttaagctagttattaaacactgcgatctgaataaacgaggtaactctccattacattgctatacgatgaatacacgatttaatccatctgtattaaagatattgttacaccacggcatgcgtaactttgatagcaaggatgaccactatcaatcgataacaagatctttgatatactaa

SEQ ID NO: 462 - protein, 137 aa, vaccinia virus; identical to SEQ ID NO: 14

SEQ ID NO: 463 - DNA, 387 bp, vaccinia virus; identical to SEQ ID NO: 11
  CDS (1)...(387)

SEQ ID NO: 464 - protein, 128 aa, vaccinia virus; identical to SEQ ID NO: 12

SEQ ID NO: 465 - DNA, 336 bp, vaccinia virus; identical to SEQ ID NO: 9
  CDS (1)...(336)

SEQ ID NO: 466 - protein, 111 aa, vaccinia virus; identical to SEQ ID NO: 10

SEQ ID NO: 467 - DNA, 369 bp, vaccinia virus; identical to SEQ ID NO: 7
  CDS (1)...(369)

SEQ ID NO: 468 - protein, 122 aa, vaccinia virus; identical to SEQ ID NO: 8

SEQ ID NO: 469 - DNA, 441 bp, vaccinia virus; identical to SEQ ID NO: 5
  CDS (1)...(441)

SEQ ID NO: 470 - protein, 146 aa, vaccinia virus; identical to SEQ ID NO: 6

SEQ ID NO: 471 - DNA, 726 bp, vaccinia virus
  CDS (1)...(726)
atgcatgtgcctgccagtcttcagcaatcctcctcctcgtgtacggaagaagaaaacaaacatcatatgggaatcgatgttattatcaaagtcacaaagcaagaccaaacaccgaccaatgataagatttgccaatccgtaacggaaattacagagtccgagtcagatccagatcccgaggtggaatcagaagatgattccacatcagtcgaggatgtagatcctcctaccacttattactccatcatcggtggaggtctgagaatgaactttggattcaccaaatgtcctcagattaaatccatctcagaatccgctgatggaaacacagtgaatgctagattgtccagcgtgtccccaggacaaggtaaggactctcccgcgatcactcatgaagaagctcttgctatgatcaaagactgtgaggtgtctatcgacatcagatgtagcgaagaagagaaagacagcgacatcaagacccatccagtactcgggtctaacatctctcataagaaagtgagttacgaagatatcatcggttcaacgatcgtcgatacaaaatgcgtcaagaatctagagtttagcgttcgtatcggagacatgtgcaaggaatcatctgaacttgaggtcaaggatggattcaagtatgtcgacggatcggcatctgaaggtgcaaccgatgatacttcactcatcgattcaacaaaactcaaagcgtgtgtctga

SEQ ID NO: 472 - protein, 241 aa, vaccinia virus; identical to SEQ ID NO: 4

What is claimed is:

1. A pharmaceutical composition comprising an isolated clonal strain of attenuated vaccinia virus, wherein the isolated clonal strain of attenuated vaccinia virus is ACAM1000 (ATCC Deposit No. PTA-3321).

2. A pharmaceutical composition comprising an isolated clonal strain of attenuated vaccinia virus that is obtained from cell cultures in which ACAM1000 (ATCC Deposit No. PTA-3321) has been propagated.

* * * * *

UNITED STATES PATENT AND TRADEMARK OFFICE
CERTIFICATE OF CORRECTION

| | |
|---|---|
| PATENT NO. | : 7,645,456 B2 |
| APPLICATION NO. | : 10/826680 |
| DATED | : January 12, 2010 |
| INVENTOR(S) | : Weltzin et al. |

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 877 days.

Signed and Sealed this

Twenty-eighth Day of December, 2010

David J. Kappos
*Director of the United States Patent and Trademark Office*